(12) United States Patent
Cancilla et al.

(10) Patent No.: US 12,516,321 B2
(45) Date of Patent: *Jan. 6, 2026

(54) RNA INTERFERENCE MEDIATED INHIBITION OF GENE EXPRESSION USING SHORT INTERFERING NUCLEIC ACIDS (siNA)

(71) Applicant: Sirna Therapeutics, Inc., Cambridge, MA (US)

(72) Inventors: Mark Cancilla, San Francisco, CA (US); James John Cunningham, West Point, PA (US); William Michael Flanagan, Menlo Park, CA (US); Henry J. Haringsma, San Francisco, CA (US); Denise M. Kenski, San Francisco, CA (US); Matthew G. Stanton, Rahway, NJ (US); Steven M. Stirdivant, Doylestown, PA (US); Aarron T. Willingham, San Francisco, CA (US)

(73) Assignee: Sirna Therapeutics, Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/416,945

(22) Filed: Jan. 19, 2024

(65) Prior Publication Data

US 2024/0287515 A1    Aug. 29, 2024

Related U.S. Application Data

(63) Continuation of application No. 17/510,277, filed on Oct. 25, 2021, now Pat. No. 11,932,854, which is a continuation of application No. 15/947,248, filed on Apr. 6, 2018, now Pat. No. 11,193,126, which is a continuation of application No. 14/984,065, filed on Dec. 30, 2015, now Pat. No. 9,970,005, which is a continuation of application No. 13/881,415, filed as application No. PCT/US2011/057663 on Oct. 25, 2011, now Pat. No. 9,260,471.

(60) Provisional application No. 61/408,303, filed on Oct. 29, 2010, provisional application No. 61/408,428, filed on Oct. 29, 2010.

(51) Int. Cl.
| | |
|---|---|
| *C07H 21/02* | (2006.01) |
| *A61K 31/713* | (2006.01) |
| *C12N 15/11* | (2006.01) |
| *C12N 15/113* | (2010.01) |

(52) U.S. Cl.
CPC .......... *C12N 15/113* (2013.01); *A61K 31/713* (2013.01); *C07H 21/02* (2013.01); *C12N 15/111* (2013.01); *C12N 2310/14* (2013.01); *C12N 2310/315* (2013.01); *C12N 2310/321* (2013.01); *C12N 2310/3231* (2013.01); *C12N 2310/331* (2013.01); *C12N 2310/344* (2013.01); *C12N 2310/346* (2013.01); *C12N 2310/351* (2013.01); *C12N 2320/32* (2013.01); *C12N 2320/51* (2013.01)

(58) Field of Classification Search
CPC .......................... C12N 15/113; C12N 2310/14
See application file for complete search history.

(56) References Cited

U.S. PATENT DOCUMENTS

| | | | |
|---|---|---|---|
| 4,501,729 A | 2/1985 | Boucher et al. |
| 4,987,071 A | 1/1991 | Cech et al. |
| 5,108,921 A | 4/1992 | Low et al. |
| 5,138,045 A | 8/1992 | Cook et al. |
| 5,214,136 A | 5/1993 | Lin et al. |
| 5,334,711 A | 8/1994 | Sproat et al. |
| 5,413,908 A | 5/1995 | Jeffreys |
| 5,416,016 A | 5/1995 | Low et al. |
| 5,421,818 A | 6/1995 | Arenberg |
| 5,444,650 A | 8/1995 | Abe et al. |
| 5,474,529 A | 12/1995 | Arenberg |
| 5,476,446 A | 12/1995 | Arenburg |
| 5,572,594 A | 11/1996 | Devoe et al. |
| 5,587,471 A | 12/1996 | Cook et al. |
| 5,589,332 A | 12/1996 | Shih et al. |
| 5,624,803 A | 4/1997 | Noonberg et al. |
| 5,627,053 A | 5/1997 | Usman et al. |
| 5,631,359 A | 5/1997 | Chowrira et al. |
| 5,631,360 A | 5/1997 | Usman et al. |

(Continued)

FOREIGN PATENT DOCUMENTS

| | | |
|---|---|---|
| CA | 2359180 A1 | 8/2000 |
| DE | 19925052 A1 | 12/2000 |

(Continued)

OTHER PUBLICATIONS

Morrissey et al. (Hepatology (2005) 41(6):1349-1356).*

(Continued)

*Primary Examiner* — Amy Rose Hudson

(74) *Attorney, Agent, or Firm* — McCarter & English, LLP; Maria Laccotripe Zacharakis; Deborah L. Nagle

(57) ABSTRACT

The present invention relates to compounds, compositions, and methods for the study, diagnosis, and treatment of traits, diseases and conditions that respond to the modulation of gene expression and/or activity, and/or modulate a gene expression pathway. Specifically, the invention relates to double-stranded nucleic acid molecules including small nucleic acid molecules, such as short interfering nucleic acid (siNA) molecules that are capable of mediating or that mediate RNA interference (RNAi) against target gene expression.

41 Claims, 27 Drawing Sheets

Specification includes a Sequence Listing.

(56) References Cited

U.S. PATENT DOCUMENTS

| | | |
|---|---|---|
| 5,670,633 A | 9/1997 | Cook et al. |
| 5,672,695 A | 9/1997 | Eckstein et al. |
| 5,716,824 A | 2/1998 | Beigelman et al. |
| 5,741,679 A | 4/1998 | George et al. |
| 5,792,847 A | 8/1998 | Buhr et al. |
| 5,804,683 A | 9/1998 | Usman et al. |
| 5,814,620 A | 9/1998 | Robinson et al. |
| 5,831,071 A | 11/1998 | Usman et al. |
| 5,834,186 A | 11/1998 | George et al. |
| 5,849,902 A | 12/1998 | Arrow et al. |
| 5,854,038 A | 12/1998 | Sullenger et al. |
| 5,871,914 A | 2/1999 | Nathan |
| 5,877,309 A | 3/1999 | McKay et al. |
| 5,885,968 A | 3/1999 | Biessen et al. |
| 5,889,136 A | 3/1999 | Scaringe et al. |
| 5,891,468 A | 4/1999 | Martin et al. |
| 5,898,031 A | 4/1999 | Crooke |
| 5,902,880 A | 5/1999 | Thompson |
| 5,932,580 A | 8/1999 | Levitzki et al. |
| 5,968,909 A | 10/1999 | Agrawal et al. |
| 5,985,558 A | 11/1999 | Dean et al. |
| 5,989,912 A | 11/1999 | Arrow et al. |
| 5,990,090 A | 11/1999 | Nabel |
| 5,994,517 A | 11/1999 | Ts'o et al. |
| 5,998,148 A | 12/1999 | Bennett et al. |
| 5,998,203 A | 12/1999 | Matulic-Adamic et al. |
| 5,998,206 A | 12/1999 | Cowsert |
| 6,001,311 A | 12/1999 | Brennan |
| 6,005,087 A | 12/1999 | Cook et al. |
| 6,008,400 A | 12/1999 | Scaringe et al. |
| 6,040,181 A | 3/2000 | Reed |
| 6,041,181 A | 3/2000 | Ju et al. |
| 6,045,528 A | 4/2000 | Arenberg et al. |
| 6,046,175 A | 4/2000 | Lori et al. |
| 6,054,576 A | 4/2000 | Bellon et al. |
| 6,057,156 A | 5/2000 | Akhtar et al. |
| 6,060,456 A | 5/2000 | Arnold, Jr. et al. |
| 6,069,008 A | 5/2000 | Bennett et al. |
| 6,093,702 A | 7/2000 | Malley et al. |
| 6,107,062 A | 8/2000 | Hu et al. |
| 6,107,094 A | 8/2000 | Crooke |
| 6,111,086 A | 8/2000 | Scaringe |
| 6,117,657 A | 9/2000 | Usman et al. |
| 6,120,484 A | 9/2000 | Silverstein |
| 6,133,242 A | 10/2000 | Zalewski et al. |
| 6,146,886 A | 11/2000 | Thompson |
| 6,153,737 A | 11/2000 | Manoharan et al. |
| 6,162,909 A | 12/2000 | Bellon et al. |
| 6,168,778 B1 | 1/2001 | Janjic et al. |
| 6,180,613 B1 | 1/2001 | Kaplitt et al. |
| 6,194,151 B1 | 2/2001 | Busfield |
| 6,214,805 B1 | 4/2001 | Torrence et al. |
| 6,235,310 B1 | 5/2001 | Wang et al. |
| 6,235,886 B1 | 5/2001 | Manoharan et al. |
| 6,248,878 B1 | 6/2001 | Matulic-Adamic et al. |
| 6,261,840 B1 | 7/2001 | Cowsert et al. |
| 6,300,074 B1 | 10/2001 | Gold et al. |
| 6,300,131 B1 | 10/2001 | Greider et al. |
| 6,303,773 B1 | 10/2001 | Bellon et al. |
| 6,323,184 B1 | 11/2001 | Zalewski et al. |
| 6,335,434 B1 | 1/2002 | Guzaev et al. |
| 6,346,398 B1 | 2/2002 | Pavco et al. |
| 6,348,312 B1 | 2/2002 | Peyman et al. |
| 6,350,934 B1 | 2/2002 | Zwick et al. |
| 6,353,098 B1 | 3/2002 | Usman et al. |
| 6,362,323 B1 | 3/2002 | Usman et al. |
| 6,372,427 B1 | 4/2002 | Kandimalla et al. |
| 6,395,492 B1 | 5/2002 | Manoharan et al. |
| 6,395,713 B1 | 5/2002 | Beigelman et al. |
| 6,414,134 B1 | 7/2002 | Reed |
| 6,437,117 B1 | 8/2002 | Usman et al. |
| 6,440,102 B1 | 8/2002 | Arenberg et al. |
| 6,447,796 B1 | 9/2002 | Vook et al. |
| 6,469,158 B1 | 10/2002 | Usman et al. |
| 6,476,205 B1 | 11/2002 | Buhr et al. |
| 6,503,533 B1 | 1/2003 | Korba et al. |
| 6,506,559 B1 | 1/2003 | Fire et al. |
| 6,518,268 B1 | 2/2003 | Chin et al. |
| 6,528,631 B1 | 3/2003 | Cook et al. |
| 6,565,885 B1 | 5/2003 | Tarara et al. |
| 6,568,524 B1 | 5/2003 | Cornell et al. |
| 6,573,099 B2 | 6/2003 | Graham |
| 6,582,728 B1 | 6/2003 | Platz et al. |
| 6,586,524 B2 | 7/2003 | Sagara |
| 6,592,904 B2 | 7/2003 | Platz et al. |
| 6,617,156 B1 | 9/2003 | Doucette-Stamm et al. |
| 6,656,559 B2 | 12/2003 | Mizushima et al. |
| 6,685,967 B1 | 2/2004 | Patton et al. |
| 6,733,627 B2 | 5/2004 | Krukonis et al. |
| 6,824,972 B2 | 11/2004 | Kenwrick et al. |
| 6,906,182 B2 | 6/2005 | Ts'o et al. |
| 7,022,828 B2 | 4/2006 | McSwiggen |
| 7,056,704 B2 | 6/2006 | Tuschl et al. |
| 7,078,196 B2 | 7/2006 | Tuschl et al. |
| 7,109,165 B2 | 9/2006 | Matulic-Adamic et al. |
| 7,262,177 B2 | 8/2007 | Ts'O et al. |
| 7,491,805 B2 | 2/2009 | Vargeese et al. |
| 7,833,992 B2 | 11/2010 | Vargeese et al. |
| 7,858,625 B2 | 12/2010 | Matulic-Adamic et al. |
| 7,858,769 B2 | 12/2010 | Jadhav et al. |
| 7,923,547 B2 | 4/2011 | McSwiggen et al. |
| 7,935,812 B2 | 5/2011 | McSwiggen et al. |
| 7,956,176 B2 | 6/2011 | McSwiggen et al. |
| 7,964,578 B2 | 6/2011 | Vargeese et al. |
| 7,989,612 B2 | 8/2011 | McSwiggen et al. |
| 8,106,022 B2 | 1/2012 | Manoharan et al. |
| 8,188,247 B2 | 5/2012 | Beigelman et al. |
| 8,202,979 B2 | 6/2012 | McSwiggen et al. |
| 8,232,383 B2 | 7/2012 | McSwiggen et al. |
| 8,236,944 B2 | 8/2012 | Beigelman et al. |
| 8,242,257 B2 | 8/2012 | Beigelman et al. |
| 8,268,986 B2 | 9/2012 | Beigelman et al. |
| 8,273,866 B2 | 9/2012 | McSwiggen et al. |
| 8,314,227 B2 | 11/2012 | Wengel |
| 8,329,463 B2 | 12/2012 | Tuschl et al. |
| 8,349,809 B2 | 1/2013 | Brown |
| 8,362,231 B2 | 1/2013 | Tuschl et al. |
| 8,372,968 B2 | 2/2013 | Tuschl et al. |
| 8,394,628 B2 | 3/2013 | Tuschl et al. |
| 8,420,391 B2 | 4/2013 | Tuschl et al. |
| 8,445,237 B2 | 5/2013 | Tuschl et al. |
| 8,450,467 B2 | 5/2013 | Manoharan et al. |
| 8,461,313 B2 | 6/2013 | Matulic-Adamic et al. |
| 8,507,455 B2 | 8/2013 | Manoharan et al. |
| 8,513,207 B2 | 8/2013 | Brown |
| 8,552,171 B2 | 10/2013 | Tuschl et al. |
| 8,618,277 B2 | 12/2013 | Beigelman et al. |
| 8,632,997 B2 | 1/2014 | Fuschl et al. |
| 8,648,185 B2 | 2/2014 | McSwigen et al. |
| 8,742,092 B2 | 6/2014 | Tuschl et al. |
| 8,765,930 B2 | 7/2014 | Tuschl et al. |
| 8,778,902 B2 | 7/2014 | Tuschl et al. |
| 8,790,922 B2 | 7/2014 | Tuschl et al. |
| 8,796,016 B2 | 8/2014 | Tuschl et al. |
| 8,846,894 B2 | 9/2014 | McSwiggen et al. |
| 8,927,705 B2 | 1/2015 | Brown |
| 9,260,471 B2 | 2/2016 | Cancilla et al. |
| 9,970,005 B2 | 5/2018 | Cancilla et al. |
| 11,193,126 B2 | 12/2021 | Cancilla et al. |
| 11,932,854 B2 | 3/2024 | Cancilla et al. |
| 2001/0007666 A1 | 7/2001 | Hoffman et al. |
| 2002/0037866 A1 | 3/2002 | Schlingensiepen et al. |
| 2002/0086356 A1 | 7/2002 | Tuschl et al. |
| 2002/0130430 A1 | 9/2002 | Castor |
| 2002/0137210 A1 | 9/2002 | Churikov |
| 2002/0151693 A1 | 10/2002 | Breaker et al. |
| 2003/0059944 A1 | 3/2003 | Lois-Caballe et al. |
| 2003/0064945 A1 | 4/2003 | Akhtar et al. |
| 2003/0077829 A1 | 4/2003 | MacLachlan |
| 2003/0083294 A1 | 5/2003 | Sullenger et al. |
| 2003/0087855 A1 | 5/2003 | Ward et al. |
| 2003/0124513 A1 | 7/2003 | McSwiggen |
| 2003/0130186 A1 | 7/2003 | Vargeese et al. |
| 2003/0143732 A1 | 7/2003 | Fosnaugh et al. |

(56) References Cited

U.S. PATENT DOCUMENTS

| | | |
|---|---|---|
| 2003/0190635 A1 | 10/2003 | McSwiggen |
| 2003/0206887 A1 | 11/2003 | Morrissey et al. |
| 2004/0019001 A1 | 1/2004 | McSwiggen |
| 2004/0037780 A1 | 2/2004 | Parsons et al. |
| 2004/0110296 A1 | 6/2004 | Vargeese et al. |
| 2004/0161844 A1 | 8/2004 | Baker et al. |
| 2004/0180351 A1 | 9/2004 | Giese et al. |
| 2004/0192626 A1 | 9/2004 | McSwiggen et al. |
| 2004/0219671 A1 | 11/2004 | McSwiggen et al. |
| 2004/0259247 A1 | 12/2004 | Tuschl et al. |
| 2005/0020521 A1 | 1/2005 | Rana |
| 2005/0020525 A1 | 1/2005 | McSwiggen et al. |
| 2005/0032733 A1 | 2/2005 | McSwiggen et al. |
| 2005/0048529 A1 | 3/2005 | McSwiggen |
| 2005/0079610 A1 | 4/2005 | Polisky et al. |
| 2005/0080246 A1 | 4/2005 | Allerson et al. |
| 2005/0106726 A1 | 5/2005 | McSwiggen et al. |
| 2005/0137155 A1 | 6/2005 | McSwiggen et al. |
| 2005/0176665 A1 | 8/2005 | McSwiggen |
| 2005/0182005 A1 | 8/2005 | Tuschl et al. |
| 2005/0209180 A1 | 9/2005 | Jadhav et al. |
| 2005/0227256 A1 | 10/2005 | Hutvagner et al. |
| 2005/0233329 A1 | 10/2005 | McSwiggen et al. |
| 2005/0239731 A1 | 10/2005 | McSwiggen et al. |
| 2005/0266422 A1 | 12/2005 | Vagle et al. |
| 2005/0282188 A1 | 12/2005 | Haeberli et al. |
| 2006/0083780 A1 | 4/2006 | Heyes et al. |
| 2006/0217331 A1 | 9/2006 | Vargeese et al. |
| 2006/0217332 A1 | 9/2006 | Vargeese et al. |
| 2006/0217334 A1 | 9/2006 | McSwiggen et al. |
| 2006/0217335 A1 | 9/2006 | McSwiggen et al. |
| 2006/0217336 A1 | 9/2006 | McSwiggen et al. |
| 2006/0217337 A1 | 9/2006 | McSwiggen et al. |
| 2006/0240554 A1 | 10/2006 | Chen et al. |
| 2006/0247428 A1 | 11/2006 | McSwiggen et al. |
| 2006/0247429 A1 | 11/2006 | McSwiggen et al. |
| 2006/0275903 A1 | 12/2006 | McSwiggen et al. |
| 2006/0276635 A1 | 12/2006 | McSwiggen et al. |
| 2006/0281175 A1 | 12/2006 | McSwiggen et al. |
| 2006/0287266 A1 | 12/2006 | McSwiggen et al. |
| 2006/0292691 A1 | 12/2006 | McSwiggen et al. |
| 2006/0293271 A1 | 12/2006 | McSwiggen et al. |
| 2006/0293272 A1 | 12/2006 | McSwiggen et al. |
| 2007/0004663 A1 | 1/2007 | McSwiggen et al. |
| 2007/0004664 A1 | 1/2007 | McSwiggen et al. |
| 2007/0004665 A1 | 1/2007 | McSwiggen et al. |
| 2007/0004667 A1 | 1/2007 | McSwiggen et al. |
| 2007/0032441 A1 | 2/2007 | McSwiggen et al. |
| 2007/0037883 A1 | 2/2007 | Dusting |
| 2007/0042983 A1 | 2/2007 | Haeberli et al. |
| 2007/0160980 A1 | 7/2007 | Haeberli et al. |
| 2007/0167393 A1 | 7/2007 | McSwiggen et al. |
| 2007/0270579 A1 | 11/2007 | Jadhav et al. |
| 2008/0020058 A1 | 1/2008 | Chen et al. |
| 2008/0039412 A1 | 2/2008 | Jadhav et al. |
| 2008/0039414 A1 | 2/2008 | McSwiggen et al. |
| 2008/0161256 A1 | 7/2008 | Morrisey et al. |
| 2008/0249046 A1 | 10/2008 | MacLachlan et al. |
| 2008/0249294 A1 | 10/2008 | Haeberli et al. |
| 2009/0023675 A1 | 1/2009 | McSwiggen et al. |
| 2009/0137500 A1 | 5/2009 | McSwiggen et al. |
| 2009/0176725 A1 | 7/2009 | Morrissey et al. |
| 2009/0176728 A1 | 7/2009 | Yague |
| 2009/0247608 A1 | 10/2009 | Manoharan et al. |
| 2009/0263407 A1 | 10/2009 | Dande et al. |
| 2009/0306184 A1 | 12/2009 | McSwiggen et al. |
| 2010/0105933 A1 | 4/2010 | Chen et al. |
| 2010/0145038 A1 | 6/2010 | McSwiggen et al. |
| 2010/0168205 A1 | 7/2010 | Meyers |
| 2010/0240730 A1 | 9/2010 | Beigelman et al. |
| 2011/0014123 A1 | 1/2011 | Tuschl et al. |
| 2011/0020234 A1 | 1/2011 | Tuschl et al. |
| 2011/0065773 A1 | 3/2011 | Tuschl et al. |
| 2011/0112283 A1 | 5/2011 | Tuschl et al. |
| 2011/0118335 A1 | 5/2011 | Jadhav et al. |
| 2011/0124853 A1 | 5/2011 | Chen et al. |
| 2011/0263683 A1 | 10/2011 | Beigelman et al. |
| 2011/0301219 A1 | 12/2011 | Beigelman et al. |
| 2011/0301220 A1 | 12/2011 | Beigelman et al. |
| 2012/0015042 A1 | 1/2012 | Tuschl et al. |
| 2012/0122111 A1 | 5/2012 | Tuschl et al. |
| 2013/0012567 A1 | 1/2013 | McSwigen et al. |
| 2013/0018082 A1 | 1/2013 | McSwigen et al. |
| 2013/0096290 A1 | 4/2013 | Brown |
| 2013/0123342 A1 | 5/2013 | Brown |
| 2013/0125259 A1 | 5/2013 | Tuschl et al. |
| 2013/0171242 A1 | 7/2013 | Lim et al. |
| 2013/0178512 A1 | 7/2013 | Manoharan et al. |
| 2013/0198875 A1 | 8/2013 | Tuschl et al. |
| 2013/0217756 A1 | 8/2013 | Cancilla et al. |
| 2013/0225652 A1 | 8/2013 | Chorn et al. |
| 2014/0045919 A1 | 2/2014 | Manoharan et al. |
| 2014/0134399 A1 | 5/2014 | Kirby et al. |
| 2014/0179761 A1 | 6/2014 | Manoharan et al. |
| 2014/0221454 A1 | 8/2014 | Brown |
| 2014/0288148 A1 | 9/2014 | Beigelman et al. |
| 2015/0038554 A1 | 2/2015 | Brown |
| 2015/0038555 A1 | 2/2015 | Brown |

FOREIGN PATENT DOCUMENTS

| | | |
|---|---|---|
| EP | 0653439 A3 | 10/1995 |
| EP | 0808898 A1 | 11/1997 |
| EP | 1144623 A1 | 10/2001 |
| EP | 1212416 A2 | 6/2002 |
| EP | 1389637 A1 | 2/2004 |
| EP | 1458741 A2 | 9/2004 |
| EP | 1572067 A2 | 9/2005 |
| EP | 1622572 A2 | 2/2006 |
| EP | 1627061 A2 | 2/2006 |
| EP | 1675948 A2 | 7/2006 |
| EP | 1682661 A2 | 7/2006 |
| EP | 1710307 A2 | 10/2006 |
| EP | 1713915 A2 | 10/2006 |
| EP | 1931781 A2 | 6/2008 |
| EP | 2042510 A3 | 6/2009 |
| EP | 1423406 B1 | 9/2010 |
| EP | 2278004 A1 | 1/2011 |
| EP | 2287305 A1 | 2/2011 |
| EP | 2287306 A1 | 2/2011 |
| EP | 2415486 A2 | 2/2012 |
| JP | 08208687 | 8/1996 |
| WO | WO-8809810 A1 | 12/1988 |
| WO | WO-8902439 A1 | 3/1989 |
| WO | WO-9012096 A1 | 10/1990 |
| WO | WO-9014090 A1 | 11/1990 |
| WO | WO-9103162 A1 | 3/1991 |
| WO | WO-9115580 A1 | 10/1991 |
| WO | WO-9207065 A1 | 4/1992 |
| WO | WO-9315187 A1 | 8/1993 |
| WO | WO-9323569 A1 | 11/1993 |
| WO | WO-9401550 A1 | 1/1994 |
| WO | WO-9402595 A1 | 2/1994 |
| WO | WO-9504142 A3 | 3/1995 |
| WO | WO-9509236 A1 | 4/1995 |
| WO | WO-9511304 A1 | 4/1995 |
| WO | WO-9511910 A1 | 5/1995 |
| WO | WO-9506731 A3 | 7/1995 |
| WO | WO-9532986 A1 | 12/1995 |
| WO | WO-1996/010392 A1 | 4/1996 |
| WO | WO-9610390 A1 | 4/1996 |
| WO | WO-9610391 A1 | 4/1996 |
| WO | WO-9622689 A1 | 8/1996 |
| WO | WO-9618736 A3 | 9/1996 |
| WO | WO-9718312 A1 | 5/1997 |
| WO | WO-9721808 A1 | 6/1997 |
| WO | WO-9726270 A3 | 11/1997 |
| WO | WO-9813526 A1 | 4/1998 |
| WO | WO-9827104 A1 | 6/1998 |
| WO | WO-9828317 A3 | 9/1998 |
| WO | WO-9843993 A2 | 10/1998 |
| WO | WO-9858058 A1 | 12/1998 |
| WO | WO-9903819 A1 | 1/1999 |
| WO | WO-9904819 A1 | 2/1999 |

(56) References Cited

FOREIGN PATENT DOCUMENTS

| | | |
|---|---|---|
| WO | WO-9905094 A1 | 2/1999 |
| WO | WO-9907409 A1 | 2/1999 |
| WO | WO-9917120 A1 | 4/1999 |
| WO | WO-199913886 B1 | 4/1999 |
| WO | WO-9916871 A3 | 5/1999 |
| WO | WO-9929842 A1 | 6/1999 |
| WO | WO-199929350 A1 | 6/1999 |
| WO | WO-9932619 A1 | 7/1999 |
| WO | WO-1999/014226 A3 | 8/1999 |
| WO | WO-9931262 A3 | 9/1999 |
| WO | WO-9949029 A1 | 9/1999 |
| WO | WO-9953050 A1 | 10/1999 |
| WO | WO-9954459 A2 | 10/1999 |
| WO | WO-9955857 A2 | 11/1999 |
| WO | WO-9906540 A3 | 12/1999 |
| WO | WO-9961631 A1 | 12/1999 |
| WO | WO-9966063 A2 | 12/1999 |
| WO | WO-0001846 A2 | 1/2000 |
| WO | WO-0003683 A3 | 4/2000 |
| WO | WO-0026226 A1 | 5/2000 |
| WO | WO-0024931 A3 | 8/2000 |
| WO | WO-0044914 A1 | 8/2000 |
| WO | WO-0049035 A1 | 8/2000 |
| WO | WO-200044895 A1 | 8/2000 |
| WO | WO-0021560 A9 | 9/2000 |
| WO | WO-0053722 A2 | 9/2000 |
| WO | WO-0063364 A2 | 10/2000 |
| WO | WO-0066604 A2 | 11/2000 |
| WO | WO-0017369 B1 | 12/2000 |
| WO | WO-0078431 A1 | 12/2000 |
| WO | WO-0104313 A1 | 1/2001 |
| WO | WO-0111023 A1 | 2/2001 |
| WO | WO-0129058 A1 | 4/2001 |
| WO | WO-0138551 A1 | 5/2001 |
| WO | WO-200136646 A1 | 5/2001 |
| WO | WO-0142443 A1 | 6/2001 |
| WO | WO-0149844 A1 | 7/2001 |
| WO | WO-0153475 A2 | 7/2001 |
| WO | WO-200153528 A1 | 7/2001 |
| WO | WO-0116312 A3 | 8/2001 |
| WO | WO-0161030 A2 | 8/2001 |
| WO | WO-0170944 A2 | 9/2001 |
| WO | WO-0170949 A1 | 9/2001 |
| WO | WO-200168836 A2 | 9/2001 |
| WO | WO-0172774 A2 | 10/2001 |
| WO | WO-0174136 A2 | 10/2001 |
| WO | WO-200175164 A2 | 10/2001 |
| WO | WO-0183740 A2 | 11/2001 |
| WO | WO-0192513 A1 | 12/2001 |
| WO | WO-0196388 A2 | 12/2001 |
| WO | WO-0196584 A2 | 12/2001 |
| WO | WO-01097850 A2 | 12/2001 |
| WO | WO-2002007747 A1 | 1/2002 |
| WO | WO-0210374 A2 | 2/2002 |
| WO | WO-0210378 A2 | 2/2002 |
| WO | WO-0222636 A1 | 3/2002 |
| WO | WO-0238805 A2 | 5/2002 |
| WO | WO-2002044321 A2 | 6/2002 |
| WO | WO-02055692 A2 | 7/2002 |
| WO | WO-02055693 A2 | 7/2002 |
| WO | WO-0215876 A3 | 8/2002 |
| WO | WO-200216620 A3 | 8/2002 |
| WO | WO-2002081494 A1 | 10/2002 |
| WO | WO-2002094185 A2 | 11/2002 |
| WO | WO-02096927 A2 | 12/2002 |
| WO | WO-03005346 A1 | 1/2003 |
| WO | WO-03016572 A1 | 2/2003 |
| WO | WO-03024420 A1 | 3/2003 |
| WO | WO-03005028 A8 | 5/2003 |
| WO | WO-03043689 A1 | 5/2003 |
| WO | WO-03044188 A1 | 5/2003 |
| WO | WO-03046185 A1 | 6/2003 |
| WO | WO-03064625 A2 | 8/2003 |
| WO | WO-03064626 A2 | 8/2003 |
| WO | WO-03068797 A1 | 8/2003 |
| WO | WO-03070193 A2 | 8/2003 |
| WO | WO-03070887 A2 | 8/2003 |
| WO | WO-03070896 A2 | 8/2003 |
| WO | WO-03070910 A2 | 8/2003 |
| WO | WO-2003064621 A2 | 8/2003 |
| WO | WO-2003070197 A2 | 8/2003 |
| WO | WO-2003070742 A2 | 8/2003 |
| WO | WO-2003070743 A1 | 8/2003 |
| WO | WO-2003070744 A1 | 8/2003 |
| WO | WO-2003070750 A2 | 8/2003 |
| WO | WO-2003070881 A2 | 8/2003 |
| WO | WO-2003070884 A2 | 8/2003 |
| WO | WO-2003070886 A2 | 8/2003 |
| WO | WO-2003070888 A2 | 8/2003 |
| WO | WO-2003070895 A2 | 8/2003 |
| WO | WO-2003070897 A2 | 8/2003 |
| WO | WO-2003070903 A2 | 8/2003 |
| WO | WO-2003070911 A2 | 8/2003 |
| WO | WO-2003070912 A2 | 8/2003 |
| WO | WO-2003070917 A2 | 8/2003 |
| WO | WO-2003070918 A2 | 8/2003 |
| WO | WO-2003070966 A2 | 8/2003 |
| WO | WO-2003070968 A2 | 8/2003 |
| WO | WO-2003070969 A2 | 8/2003 |
| WO | WO-2003070970 A2 | 8/2003 |
| WO | WO-2003070972 A2 | 8/2003 |
| WO | WO-2003070983 A1 | 8/2003 |
| WO | WO-2003/074654 A2 | 9/2003 |
| WO | WO-03072590 A1 | 9/2003 |
| WO | WO-03030989 A3 | 10/2003 |
| WO | WO-03047518 A3 | 10/2003 |
| WO | WO-03034985 A3 | 11/2003 |
| WO | WO-03080638 A9 | 11/2003 |
| WO | WO-2003072705 A3 | 11/2003 |
| WO | WO-03099298 A1 | 12/2003 |
| WO | WO-03104456 A1 | 12/2003 |
| WO | WO-2003070914 A3 | 12/2003 |
| WO | WO-2003072704 A3 | 12/2003 |
| WO | WO-2003106476 A1 | 12/2003 |
| WO | WO-04009769 A2 | 1/2004 |
| WO | WO-04013280 A2 | 2/2004 |
| WO | WO-2004015107 A2 | 2/2004 |
| WO | WO-04029212 A2 | 4/2004 |
| WO | WO-04043977 A2 | 5/2004 |
| WO | WO-04009794 A3 | 6/2004 |
| WO | WO-04048566 A1 | 6/2004 |
| WO | WO-04072261 A2 | 8/2004 |
| WO | WO-04090105 A2 | 10/2004 |
| WO | WO-2004097020 A2 | 11/2004 |
| WO | WO-05014859 A1 | 2/2005 |
| WO | WO-2005028649 A1 | 3/2005 |
| WO | WO-2005028650 A2 | 3/2005 |
| WO | WO-2005041859 A2 | 5/2005 |
| WO | WO-2005044981 A2 | 5/2005 |
| WO | WO-2005045034 A2 | 5/2005 |
| WO | WO-05049821 A1 | 6/2005 |
| WO | WO-2005019453 A3 | 6/2005 |
| WO | WO-2005078097 A3 | 10/2005 |
| WO | WO-2007022369 A2 | 2/2007 |
| WO | WO-2008147824 A2 | 12/2008 |
| WO | WO-2009/073809 A2 | 6/2009 |
| WO | WO-2009/082607 A2 | 7/2009 |
| WO | WO-2009/134487 A2 | 11/2009 |
| WO | WO-2009/082606 A3 | 12/2009 |
| WO | WO-2010111471 A3 | 11/2010 |
| WO | PCT/US2011/057663 | 10/2011 |
| WO | WO-2012/068187 A1 | 5/2012 |
| WO | WO-2013/074974 A2 | 5/2013 |
| WO | WO-2013/165816 A2 | 11/2013 |
| WO | WO-2015003113 A3 | 2/2015 |

OTHER PUBLICATIONS

Dowler et al. (Nucleic Acids Research, 2006, 34, 6, 1669-1675).*
U.S. Appl. No. 13/881,415 now U.S. Pat. No. 9,260,471, filed May 10, 2013 Feb. 16, 2016, US 20130217756, Granted.
U.S. Appl. No. 14/984,065 U.S. Pat. No. 9,970,005, filed Dec. 30, 2015, May 15, 2018, US 20160264964, Granted.

(56) References Cited

OTHER PUBLICATIONS

U.S. Appl. No. 15/947,248 U.S. Pat. No. 11,193,126, filed Apr. 6, 2018 Dec. 7, 2021, US 20180362977, Granted.
U.S. Appl. No. 17/510,277 U.S. Pat. No. 11,932,854, filed Oct. 25, 2021 Mar. 19, 2024, US 20220195433, Granted.
Rand et al., "Argonaute2 cleaves the anti-guide strand of siRNA during RISC activation," Cell, 123:621-629 (2005).
Egholm et al., "PNA hybridizes to complementary oligonucleotides obeying the Watson-Crick hydrogen-bonding rules," Nature 365:566-568 (1993).
Elbashir et al., "Duplexes of 21-nucleotide RNAs mediate RNA interference in cultured mammalian cells," Nature 411:494-498 (2001).
McCaffrey et al., "RNA interference in adult mice," Nature 418:38-39 (2002).
McManus et al., "Gene silencing using micro-RNA designed hairpins," RNA 8:842-850 (2002).
Sarver et al., "Ribozymes as potential anti-HIV-1 therapeutic agents," Science 247:1222-1225 (1990).
Hermann and Patel, "Adaptive Recognition by Nucleic Acid Aptamers," Science, 287:820-825 (2000).
Bongartz et al., "Improved biological activity of antisense oligonucleotides conjugated to a fusogenic peptide," Nucleic Acids Research 22:4681-4688 (1994).
Elbashir et al. "Functional anatomy of siRNAs for mediating efficient RNAi in Drosophila melanogaster embryo lysate," EMBO J. 20(23):6877-6888 (2001).
Filion and Phillips, "Toxicity and immunomodulatory activity of liposomal vectors formulated with cationic lipids toward immune effector cells," Biochimica et Biophysica Acta 1329:345-356 (1997).
Hartmann et al., "Spontaneous and Cationic Lipid-Mediated Uptake of Antisense Oligonucleotides in Human Monocytes and Lymphocytes," The Journal of Pharmacology and Experimental Therapeutics 285:920-928 (1998).
Hong et al., "pH-sensivite, serum-stable and long-circulating liposomes as a new drug delivery system," Journal of Pharmacy and Pharmacology, 54:51-58 (2002).
Kronenwett et al., "Oligodeoxyribonucleotide Uptake in Primary Human Hematopoietic Cells is Enhanced by Cationic Lipids and Depends on the Hematopoietic Cell Subset," Blood 91:852-862 (1998).
Ma and Wei, "Enhanced Delivery of Synthetic Oligonucleotides to Human Leukaemic Cells by Liposomes and Immunoliposomes," Leukemia Research 20:925-930 (1996).
Martinez et al., "Single-Stranded Antisense siRNAs Guide Target RNA Cleavage in RNAi," Cell 110:563-574 (2002).
Matsuno et al., "Hepatocyte growth factor gene transfer into the liver via the portal vein using electroporation attenuates rat liver cirrhosis," Gene Therapy 10:1559-1566 (2003).
Murao et al., "Targeting Efficiency of Galactosylated Liposomes to Hepatocytes in Vivo: Effect of Lipid Composition," Pharmaceutical Research, 19(12):1808-1814 (2002).
Schwarz et al., "Evidence that siRNA's Function as Guides, Not Primers, in the Drosophila and Human RNAi Pathways," Molecular Cell 10: 537-548 (2002).
Zamore et al., "RNAi: Double-Stranded Rna Directs the ATP-Dependent Cleavage of mRNA at 21 to 23 Nucleotide Intervals," Cell 101:25-33 (2000).
Usman et al., "Automated Chemical Synthesis of Long Oligoribonucleotides Using 2'-O-Silylated Ribonucleoside 3'-O-Phosphoramidites on a Controlled-Pore Glass Support: Synthesis of a 43-Nucleotide Sequence Similar to the 3'-Half Molecule of an<i>Escherichia coli</i>Formylmethoionine tRNA," J. Am. Chem. Soc. 109:7845-7854 (1987).
Usman et al., "Hammerhead ribozyme engineering," Current Opinion in Structural Biology 6:527-533 (1996).
Vaish et al., "Isolation of Hammerhead Ribozymes with Altered Core Sequences by in Vitro Selection," Biochemistry 36:6495-6501 (1997).

Varambally et al., "The polycomb group protein EZH2 is involved in progression of prostate cancer," Nature, 419, 624-629 (2002).
Vassar et al., "b-Secretase Cleavage of Alzheimer's Amyloid Precursor Protein by the Transmembrane Aspartic Protease BACE," Science 286:735-741 (1999).
Vaughn and Martienssen, "It's a Small RNA World, After All," Science, 309, 1525-1526 (2005).
Verdel et al., "RNAi-Mediated Targeting ofHeterochromatin by the RITS Complex," Science, 303, 672-676 (2004).
Verma and Eckstein, "Modified Oligonucleotides: Synthesis and Strategy for Users," Annu. Rev. Biochem. 67:99-134 (1998).
Vickers et al., "Efficient Reduction of Target RNAs by Small Interfering RNA and RNase H-dependent Antisense Agents," Journal of Biological Chemistry, 278, 7108-7118 (2003).
Volpe et al., "Regulation of Heterochromatic Silencing and Histone H3 Lysine-9 Methylation by RNAi," Science 297:1833-1837 (2002).
Wang et al., "Delivery of Antisense Oligodeoxyribonucleotides Against the Human Epidermal Growth Factor Receptor Into Cultured KB Cells with Liposomes Conjugated to Folate via Polyethylene Glycol," Proc. Natl. Acad. Sci. USA 92:3318-3322 (1995).
Wang et al., "Small Hairpin RNAs Efficiently Inhibit Hepatitis C IRES-Mediated Gene Expression in Human Tissue Culture Cells and a Mouse Model," 2005, Molecular Therapy, vol. 12, No. 3, pp. 562-568.
Waterhouse et al., "Virus resistance and gene silencing in plants can be induced by simultaneous expression of sense and antisense RNA," Proc. Natl. Acad Sci. USA, 95, 13959-13964 (1998).
Wen et al., "Preparation and property analysis of a hepatocyte targeting pH-sensitive liposome," World J Gastroenterology, 10(2):244-249 (2004).
Werner and Uhlenbeck, "The effect of base mismatches in the substrate recognition helices of hammerhead ribozymes on binding and catalysis," Nucleic Acids Research 23:2092-2096 (1995).
Wianny and Zernicka-Goetz et al., "Specific Interference with Gene Function by Double-Stranded RNA in Early Mouse Development," Nature Cell Biology 2:70-75 (2000).
Wilda et al., "Killing of leukemic cells with a BCRIABL fusion gene by RNA interference (RNAi)," Oncogene, 21, 5716-5724 (2002).
Wincott et al., "A Practical Method for the Production of RNA and Ribozymes," Methods in Molecular Biology 74:59-69 (1997).
Wincott et al., "Synthesis, deprotection, analysis and purification of RNA and ribozymes," Nucleic Acids Research 23(14):2677-2684 (1995).
Withdrawal of an opposition (dated Mar. 10, 2014, from European Application EP1458741).
Woolf et al., "Specificity of Antisense Oligonucleotides in vivo," Proc. Natl. Acad. Sci. USA 89:7305-7309 (1992).
Wraight et al., "Anitsense oligonucleotides in cutaneous therapy," Pharmacology & Therapeutics, 90, 89-104 (2001).
Written submission by Patentee during examination proceedings for European application EP1423406 dated Oct. 13, 2009.
Wu and Kaufman, "A Model for the Double-stranded RNA (dsRNA)-dependent Dimerization and Activation of the dsRNA-activated Protein Kinase PKR," The Journal of Biological Chemistry, 272:2, 1291-1296 (1997).
Wu and Wu, "Receptor-mediated in Vitro Gene Transformation by a Soluble DNA Carrier System," The Journ. of Biol. Chem. 262:4429-4432 (1987).
Wu et al., "Small Interfering RNA-induced Suppression of MDR1 (P-Giycoprotein) Restores Sensitiviy to Multidrug-resistant Cancer Cells," Cancer Research, 63, 1515-1519 (2003).
Wu-Pong et al., "Nucleic Acid Drug Delivery, Part 2; Delivery to the Brain," 38 (1999) BioPharm 32-38 (1999).
Yamada et al., "Human Gastric Inhibitory Polypeptide Receptor: Cloning of the Gene (GIPR) and eDNA," Genomics, 29, 773-776 (1995).
Yamada et al., "Nanoparticles for the delivery of genes and drugs to human hepatocytes," Nature Biotechnology, Published online: Jun. 29, 2003, doi:10. 1038/nbt843 (Aug. 2003 vol. 21 No. 8 pp. 885-890) (2003).
Yan et al., "Membrane-anchored Aspartyl Protease with Alzheimer's Disease b-Secretase Activity," Nature 402:533-537 (1999).

(56) References Cited

OTHER PUBLICATIONS

Yang et al., "Hydrodynamic injection of viral DNA: A mouse model of acute hepatitis B virus infection," PNAS, 99, 21, 13825-13830 (2002).
Ying et al., "Intron-derived microRNAs-fine tuning of gene functions", Gene, 342, 25-28 (2004).
Yu et al., "A Hairpin Ribozyme Inhibits Expression of Diverse Strains of Human Immunodeficiency Virus Type 1 ," Proc. Natl. Acad. Sci. USA 90:6340-6344 (1993).
Yu et al., "Antisense inhibition of Chk2/hCds1 expression attenuates DNA damage-induced S and G2 checkpoints and enhances apoptotic activity in HEK-293 cells," FEBS Letters, 505,7-12 (2001).
Zamore and Haley, "Ribo-gnome: The Big World of Small RNAs," Science, 309, 1519-1524 (2005).
Zeng et al., "Prenylation-dependent Association of Protein-tyrosine Phosphatases PRL-1, -2, arid -3 with the Plasma Membrane and the Early Endosome," The Journal of Biological Chemistry, 275:28, 21444-21452 (2000).
Zhang et al., "Single Processing Center Models for Human Dicer and Bacterial RNase III," Cell, 118:57-68 (2004).
Zhou et al., "Probing of the secondary structure of maxizymes," Nucleic Acids Symposium Series No. 42, 219-220 (1999).
Zhou et al., "Synthesis of Functional mRNA in Mammalian Cells by Bacteriophage T3 RNA Polymerase," Mol. Cell. Biol. 10:4529-4537 (1990).
Zimmerly et al., "A Group II Intron RNA is a Catalytic Component of a DNA Endonuclease Involved in Intron Mobility," Cell 83:529-538 (1995).
European Search Report for EP App. 10 00 8929 dated Dec. 20, 2010.
Extended European Search Report from European Application No. 14195627.6 dated Jul. 6, 2015.
Feldstein et al., "Two sequences participating in the autolytic processing of satellite tobacco ringspot virus complementary RNA," Gene 82:53-61 (1989).
Ferentz and Verdine, "Disulfied Cross-Linked Oligonucleotides," J. Am. Chem. Soc. 113:4000-4002 (1991).
Findeis, "Stepwise Synthesis of a GaiNAc-containing Cluster Glycoside Ligand of the Asialoglycoprotein Receptor," Int J. Peptide Protein Res. 43:477-485 (1994).
Fire et al., "Potent and Specific Genetic Interference by Double-Stranded RNA in Caenorhabditis Elegans," Nature 391 :806-811(1998).
Fire, "RNA-triggered Gene Silencing," TIG 15:358-363(1999).
Forster and Altman, "External Guide Sequences for an RNA Enzyme," Science 249:783-786 (1990).
Fox, "Targeting DNA with Triplexes," Current Medicinal Chemistry 7:17-37 (2000).
Fraser et al., "Functional genomic analysis of C. elegans chromosome I by systematic RNA interference," Nature, 408, 325-330 (2000).
Freier et al., "Improved free-energy parameters for predictions of RNA duplex stability," Proc. Natl. Acad. Sci. USA 83:9373-9377 (1986) [sometimes referred to as Frier].
Freier et al., "The ups and downs of nucleic acid duplex stability: structure-stability studies on chemically-modified DNA:RNA duplexes", Nucl. Acids Res 25:4429-4443 (1997).
Furgeson et al., "Modified Linear Polyethylenimine-Cholesterol Conjugates for DNA Complexation," Bioconjugate Chem., 14, 840-847 (2003).
Furuno et al., "Expression polymorphism of the blood-brain barrier component P-glycoprotein (MDR1) in relation to Parkinson's disease," Pharmacogenetics, 12, 7, 529-534 (2002).
Futami et al., "Induction of Apoptosis in HeLa Cells with siRNA Expression Vector Targeted Against bcl-2," Nucleic Acids Research Supplement 2:251-252 (2002).
Galani et al., "Correlation of MDR-1, nm23-H1 and H Sema E Gene Expression with Histopathological Findings and Clincial Outcome in Ovarian and Breast Cancer Patients," Anticancer Research, 22:2275-2280 (2002).
Gao and Huang, "Cytoplasmic Expression of a Reporter Gene by Co-Delivery of T7 RNA Polymerase and T7 Promoter Sequence with Cationic Liposomes," Nucleic Acids Research 21:2867-2872 (1993).
Ghimikar et al., "Chemokine inhibition in rat stab would brain injury using antisense oligodeoxynucleotides," Neuroscience Letters 247:21-24 (1998).
Godbey et al., "Poly(ethylenimine) and its role in gene delivery," Journal of Controlled Release, 60, 149-160 (1999).
Godbey et al., "Tracking the intracellular path of poly(ethylenimine)/DNA complexes for gene delivery," Proc. Natl. Acad. Sci. USA, 96, 5177-5181 (1999).
Godwin et al., "The Synthesis of Biologically Active Pteroyloligo-y-L-Giutamates (Folic Acid Conjugates}," The Journal of Biolooical Chemistry 247:2266-2271 (1972).
Gold et al., "Diversity of Oligonucleotide Functions," Annu. Rev. Biochem. 64:763-797 (1995).
Goldstein et al., "Protine-Tyrosine Phosphatase 1 B (PTP1 B): A Novel Therapeutic Target for Type 2 Diabetes Mellitus, Obesity and Related States of Insulin Resistance," Curr. Drug Targets, 1, 265-275 (2001).
Gonczy et al., "Functional genomic analysis of cell division in C. elegans using RNAi of genes in chromosome III," Nature, 408, 331-336 (2000).
Gonzalez et al., "New Class of Polymers for the Delivery of Macromolecular Therapeutics," Bioconjugate Chem., 10, 1068-1074 (1999).
Good et al., "Expression of small, therapuetic RNAs in human nuclei," Gene Therapy 4:45-54 (1997).
Goruppi et al., "Signaling pathways and late-onset gene induction associated with renal mesangial cell hypertrophy," The EMBO Journal, 21, 20, 5427-5436 (2002).
Grant et al., "Insulin-like growth factor I acts as an angiogenic agent in rabbit cornea and retina: comparative studies with basic fibroblast growth factor," Diabetologia 36:282-291 (1993).
Grasby et al., "Purine Functional Groups in Essential Residues of the Hairpin Ribozyme Required for Catalytic Cleavage of RNA," Biochemistry 34:4068-4076 (1995).
Griffin et al., "Group II intron ribozymes that cleave DNA and RNA linkages with similar efficiency, and lack contacts with substrate 2'-hydroxyl groups," Chemistry & Biology 2:761-770 (1995).
Gros et al., "Mammalian Multidrug Resistance Gene: Complete eDNA Sequence Indicates Strong Homology to Bacterial Transport Proteins," Cell, 47, 371-380 (1986).
Guerrier-Takada et al., "The RNA Moiety of Ribonuclease P is the Catalytic Subunit of the Enzyme," Cell 35:849-857 (1983).
Guo and Collins, "Efficient trans-cleavage of a stem-loop RNA substrate by a ribozyme derived from NeurosporaVS RNA" EMBO J. 14:368-376 (1995).
Habus et al., "A Mild and Efficient Solid-Support Synthesis of Novel Oligonucleotide Conjugates," Bioconjugate Chem. 9:283-291 (1998).
Hamasaki et al., "Short interfering RNA-directed inhibition of hepatitis B virus replication," FEBS Letters, 543:51-54 (2003).
Hamilton, et al., "A Species of Small Antisense RNA in Post-transcriptional Gene Silencing in Plants," Science, 286, 950-952 (1999)).
Hammann et al., "Length Variation of Helix III in a Hammerhead Ribozyme and Its Influence on Cleavage Activity," Antisense & Nucleic Acid Drug Development 9:25-31 (1999).
Hammond et al., "An RNA-Directed Nuclease Mediates Post-Transcriptional Gene Silencing in Drosophila Cells," Nature 404:293-296 (2000).
Hammond et al., "Post-Transcriptional Gene Silencing by Double-Stranded RNA," Nature Reviews Genetics, 2:110-119 (2001).
Hampel and Tritz, "RNA Catalytic Properties of the Minimum (−)sTRSV Sequence," Biochemistry 28:4929-4933 (1989).

(56) References Cited

OTHER PUBLICATIONS

Hampel et al., "Hairpin' Catalytic RNA Model: Evidence for Helices and Sequence Requirement for Substrate RNA," Nucleic Acids Research 18:299-304 (1990).
Haniu et al., "Characterization of Alzheimer's b-Secretase Protein BACE," The Journal of Biological Chemistry, 275, 21099-21106 (2000).
Harborth et al., "Identification of essential genes in cultured mammalian cells using small interfering RNAs" Journal of Cell Science 114: 4557-4565 (2001).
Harborth et al., "Sequence, Chemical, and Structural Variation of Small Interfering RNAs and Short Hairpin RNAs and the Effect on Mammalian Gene Silencing," Antisense and Nucleic Acid Drug Development, 13:83-105 (2003).
Haringsma et al. "mRNA knockdown by single strand RNA is improved by chemical modifications", Nucleic Acids Research (2012) vol. 40, No. 9, pp. 4125-4136.
Harris et al., "Identification of phosphates involved in catalysis by the ribozyme RNase P RNA," RNA 1:210-218 (1995).
Haseloff and Gerlach, "Sequences required for self-catalysed cleavage of the satellite RNA of tobacco ringspot virus," Gene 82:43-52 (1989).
He et al., "MicroRNAs: Small RNAs with a Big Role in Gene Regulation," Nat. Rev. Genet., 5, 522-531 (2004).
Cardoso et al., "The human EZH2 gene: genomic organisation and revised mapping in 7q35 within the critical region for malignant myeloid disorders," European Journal of Human Genetics, 8, 174-180 (2000).
Carmichael et al., "Silencing viruses with RNA," Nature, 418, 379-380 (2002).
Caruthers et al., "Chemical Synthesis of Deoxyoligonucleotides and Deoxyoligonucleotide Analogs," Methods in Enzymology 211:3-19 (1992).
Chaloin et al., "Design of Carrier Peptide-Oligonucleotide Conjugates With Rapid Membrane Translocation and Nuclear Localization Properties," BBRC 243:601-608 (1998).
Chen et al., "Cloning of a Human Homolog of the *Drosophilia* Enhancer of zeste Gene (EZH2) That Maps to Chromosome 21 q22.2," Genomics, 38, 30-37 (1996).
Chen et al., "Genomic Organization of the Human Multidrug Resistance (MDR1) Gene and Origin of P-glycoproteins," The Journal of Biological Chemistry, 265, 1, 506-514 (1990).
Chernolovskaya et al., "Interaction of LNA Oliognucleotides with MDR1 Promoter," Nucleosides, Nucleotides & Nucleic Acids, 20, No. 4-7, 847-850 (2001).
Chin et al., "Structure and Expression of the Human MDR (P-Giycoprotein) Gene Family," Molecular and Cellular Biology, 9, 9, 3808-3820 (1989).
Chiu et al., "RNAi in Human Cells: Basic Structural and Functional Features of Small Interfering RNA," Molecular Cell 10, 549-561 (2002).
Chiu et al., "siRNA function in RNAi: A chemical modification analysis," RNA 9: 1034-1048 (2003).
Choi et al., "Effect of Poly(ethylene glycol) Grafting on Polyethylenimine as a Gene Transfer Vector in vitro," Bull. Korean Chem. Soc., 22, 46-52 (2001).
Chowrira et al., "In Vitro and in Vivo Comparison of Hammerhead, Hairpin, and Hepatitis Delta Virus Self-Processing Ribozyme Cassettes," J. Biol. Chem. 269:25856-25864 (1994).
Chumakov et al., "Genetic and Physiological Data Implicating the New Human Gene G72 and the Gene for D-amino Acid Oxidase in Schizophrenia," PNAS 99:13675-13680 (2002).
Chun et al., "Effect of infusion of vasoactive intestinal peptide (VI P)-antisense oligodeoxynucleotide into the third cerebral ventricle above the hypothalamic cuprachiasmatic nucleus on the hyperglycemia caused by intracranial injection of 2-deoxy-D-glucose in rats," Neuroscience Letters 257:135-138 (1998).
Cioca et al., "RNA interference is a functional pathway with therapeutic potential in human myeloid leukemia cell lines," Cancer Gene Therapy, 10, 125-133 (2003).

Claverie, Jean-Michel, "Fewer Genes, More Noncoding RNA," Science, 309, 1529-1530 (2005).
Clemens et al., "The Double-Stranded RNA-Dependent Protein Kinase PKR: Structure and Function," Journal of Interferon and Cytokine Research, 17:503-524 (1997).
Clemens et al., "Use of double-stranded RNA Interference in *Drosophila* cell lines to dissect signal transduction pathways," PNAS, 97, 12, 6499-6503 (2000).
Cload and Schepartz, "Polyether Tethered Oligonucleotide Probes," J. Am. Chem. Soc. 113:6324-6326 (1991).
Cole et al., "Activation of RNase L by 2',5'-Oligoadenylates," The Journal of Biological Chemistry, 272:31, 19187-19192 (1997).
Connolly et al., "Binding and Endocytosis of Cluster Glycosides by Rabbit Hepatocytes," The Journ. of Biol. Chem. 257:939-945 (1982).
Crooke et al., "Kinetic characteristics of *Escherichia coli* RNase H1: cleavage of various antisense oligonucleotide-RNA duplexes," (1995), Biochem J., 312, pp. 599-608.
Crooke, "Advances in Understanding the Pharmacological Properties of Antisense Oligonucleotides," Advances in Pharmacology 40:1-49 (1997).
Crooke, "Antisense Therapeutics," Biotechnology and Genetic Engineering Reviews 15:121-157 (1998).
Crooke, "Progress in Antisense Technology: The End of the Beginning," Methods in Enzymology 313:3-45 (1999).
Cullen, Bryan R., "Derivation and function of small interfering RNAs and microRNAs," Virus Research, 102, 3-9 (2004).
Czauderna et al., "Structural variations and stabilising modifications of synthetic siRNAs in mammalian cells," Nucleic Acids Research 31(11):2705-2716 (2003).
Czech, Michael P., "MicroRNAs as Therapeutic Targets," The New England Journal of Medicine, 354, 1194-1195 (2006).
D'Aldin et al., "Antisense oligonucleotides to the GluR2 AMPA receptor subunit modify excitatory synaptic transmission in vivo," Molecular Brain Research 55:151-164 (1998).
Database CAPLUS on STN, AN:1992:230597, Segarra et al., "Molecular Characterization of the Enterococcus faecalis Cytolysin Activator", Infection and Immunity, 1991, Vo. 59, No. 4, pp. 1239-1246.
Decision of the Opposition Division and Instruction in EP1423406 dated Apr. 16, 2015.
Decision to Discontinue the Opposition Proceedings in EP1458741 dated Apr. 16, 2015.
Defrancq and Lhomme, "Use of an Aminooxy Linker for the Functionalization of Oligodeoxyribonucleotides," Bioorganic & Medicinal Chem. Lett. 11:931-933 (2001).
Delihas et al., "Natural antisense RNA/target RNA interactions: Possible models for antisense oligonucleotide drug design," Nature Biotechnology 15:751-753 (1997).
Diebold et al., "Mannose Polyethylenimine Conjugates for Targeted DNA Delivery into Dendritic Cells," The Journal of Biological Chemistry, 274, 19087-19094 (1999).
Dryden et al., "The lack of specificity of neuropeptide Y (NPY) antisense oligodeoxynucleotides administered intracerebroventriculariy in inhibiting food intake and NPY gene expression in the rat hypothalamus," Journal of Endocrinology 157:169-175(1998).
Durand et al., "Circular Dichroism Studies of an Oligodeoxyribonucleotide Containing a Hairpin Loop Made of a Hexaethylene Glycol Chain: Conformation and Stability," Nucleic Acids Research 18:6353-6359 (1990) [sometimes referred to as Seela and Kaiser].
Duval-Valentin, "Specific inhibition of transcription by triple helix-forming oligonucleotides," Proc. Natl. Acad. Sci. USA 89:504-508 (1992).
Earnshaw et al., "Modified Oligoribonucleotides as Site-Specific Probes of RNA Structure and Function," Biopolymers 48:39-55 (1998).
Edbauer et al., "Resenilin and nicastrin regulate each other and determine amyloid b-peptide production via complex formation," PNAS, 99, 8666-8671 (2002).
Elbashir et al., "Analysis of gene function in somatic mammalian cells using small interfering RNAs," Methods, 26:199-213 (2002).

(56) References Cited

OTHER PUBLICATIONS

Elbashir et al., "RNA interference is mediated by 21- and 22-nucleotide RNAs" Genes & Development 15: 188-200 (2001).
Emerich et al., "Biocompatability of Poly (DL-Lactide-co-Glycolide) Microshperes Implanted Into the Brain," Cell Transplantation 8:47-58 (1999).
EP Appl. No. 02017601.2, filed Aug. 5, 2002, Klippel et al.
Epa et al., "Downregulation of the p75 Neurotrophin Receptor in Tissue Culture and In Vivo, Using .beta.-Cyclodextrin-Adamantane-Oligonucleotide Conjugates," Antisense and Nucleic Acid Drug Dev. 10:469-478 (2000).
Erbacher et al., Transfection and physical properties of various sacccharide, poly(ethylene glycol), and antibody-derivatized polyethylenimines (PEI), The Journal of Gene Medicine, 1, 210-222 (1999) [sometimes incorrectly cited as pp. 1-18].
European Search Report for EP App. 03 71 6126 dated Jul. 15, 2005.
Lin et al., "Human aspartic protease memapsin 2 cleaves the .beta.-secretase siet of .beta.-amyloid precursor protein," PNAS, 97, 1456-1460 (2000).
Lin et al., "Policing rogue genes," Nature, 402, 128-129 (1999).
Lisziewicz et al., "Inhibition of Human Immunodeficiency Virus Type 1 Replication by Regulated Expression of a Polymeric Tat Activation Response RNA Decoy as a Strategy for Gene Therapy in AIDS," Proc. Natl. Acad. Sci. U.S.A. 90:8000-8004 (1993).
Liu et al., "Cationic Liposome-mediated Intravenous Gene Delivery," J. Biol. Chem. 70(42):24864-24870 (1995).
Liu et al., "Hydrodynamics-based transfection in animals by systemic administration of plasmid DNA," Gene Therapy, 6, 1258-1266 (1999).
Liu et al., "Poly( cationic lipid)-mediated in vivo gene delivery to mouse liver," Gene Therapy, 10:180-187 (2003).
Loakes, "The Applications of Universal DNA Base Analogues," Nucleic Acids Research 29:2437-2447 (2001).
Lu et al., "Tumor Inhibition by RNAi-Mediated VEGF an VEGFR2 Down Regulation in Xenograft Models," Cancer Gene Therapy, 10, SuppL 1, S4-S5 (2003).
Luo et al., "Blocking CHK1 Expression Induces Apoptosis and Abrogates the G2 Checkpoint Mechanism," Neoplasia, 3:5,411-419 (2001).
Ma et al., "Design and Synthesis of RNA Miniduplexes via a Synthetic Linker Approach," Biochemistry 32:1751-1758 (1993).
Ma et al., "Design and Synthesis of RNA Miniduplexes via a Synthetic Linker Approach. 2. Generation of Covalently Closed, Double-Stranded Cyclic HIV-1 TAR RNA Analogs with High Tat-Binding Affinity," Nucleic Acids Research 21:2585-2589 (1993).
Matranga et al., "Passenger-Strand Cleavage Facilitates Assembly of siRNA into Ago2-Containing RNAi Enzyme Complexes," Cell, 123:1-114 (2005).
Maurer et al., "Lipid-based systems for the intracellular delivery of genetic drugs," Molecular Membrane Biology 16:129-140 (1999).
McCurdy et al., "Deoxyoligonucleotides with Inverted Polarity: Synthesis and Use in Triple-Helix Formation" Nucleosides & Nucleotides 10:287-290 (1991).
McGarry and Lindquist, "Inhibition of heat shock protein synthesis by heat-inducible antisense RNA," Proc. Natl. Acad. Sci. USA 83:399-403 (1986).
Mesmaeker et al., "Novel Backbone Replacements for Oligonucleotides," American Chemical Society, pp. 24-39 (1994).
Mihaly et al., "The role of the *Drosophila* TAK homologue dTAK during development," Mechanisms of Development, 102,67-79 (2001).
Miller et al., "Targeting Alzheimer's disease genes with RNA interference: An efficient strategy for silencing mutant alleles," Nucleic Acids Research, 32(2):661-668 (2004).
Milner et al., "Selecting effective antisense reagents on combinatorial oligonucleotide arrays," Nature Biotechnology 15:537-541 (1997).
Minutes of the oral proceedings (Opposition Division)—conclusion of the proceedings (Dated Apr. 25, 2014, from European application EP1423406).
Miyagishi and Taira, "U6 Promoter-driven siRNAs with Four Uridine 3' Overhangs Efficiently Suppress Targeted Gene Expression in Mammalian Cells," Nature Biotechnology 20:497-500 (2002).
Miyagishi et al., "Strategies for generation of an siRNA expression library directed against the human genome," Oligonucleotides, 13(5):325-333 (2003).
Monia et al., "Evaluation of 2'-Modified Oligonucleotides Containing 2'-Deoxy Gaps as Antisense Inhibitors of Gene Expression," J. Biol. Chem. 268:14514-14522 (1993).
Moore and Sharp, "Site-Specific Modification of Pre-mRNA: The 2'-Hydroxyl Groups at the Splice Sites," Science 256:992-996 (1992).
Morris et al., "A New Peptide Vector for Efficient Delivery of Oligonucleotides into Mammalian Cells," Nucleic Acids Research 25:2730-2736 (1997).
Morris et al., "Glycolysis modulates trypanosome glycoprotein expression as revealed by an RNAi library," The EMBO Journal, 21:17,4429-4438 (2002).
Morvan et al., "Comparative Evaluation of Seven Oligonucleotide Analogues as Potential Antisense Agents," J. Med. Chem., 36, 280-287 (1993).
Neureitter et al., "Growth inhibition of pancreatic cancer in nude mice by targeting bc12-suppression with specific short interfering RNA molecules," Pathology Research and Practice, 199(4):257 (2003) Abstract only.
Nieth et al., "Modulation of the classical multidrug resistance (MDR) phenotype by RNA interference (RNAi),".
Nishida et al., "Gab-Family Adapter Proteins Act Downstream of Cytokine and Growth Factor Receptors and T- and B-Cell Antigen Receptors," Blood, 93(6):1809-1816 (1999).
Nohara et al., "Creatinine Inhibits D-Amino Acid Oxidase," Nephron, 91:281-285 (2002).
Noiseux et al., "A Bolus Endovascular Treatment with a PDGFR-P Antisense is Sufficient to Suppress Intimal Thickening in a Rat Carotid Injury Model," Circulation, 100(18) Supplement 1-816 (1999).
Nomura et al., "Development of an Efficient Intermediate, a-[2-(Trimethylsilyl) ethoxy]-2-N-[2-trimethylsilyl) ethoxycarbonyl]folic Acid, for the Synthesis of Folate (y)-Conjugates, and Its Application to the Synthesis of Folate-Nucleoside Conjugates," J. Org. Chem. 65:5016-5021 (2000).
Noonberg et al., "In vivo generation of highly abundant sequence-specific oligonucleotides for antisense and triplex gene regulation," Nucleic Acids Research 22(14):2830-2836 (1994).
Notice of Opposition by Alcon Research to European Application EP1423406, dated Jun. 1, 2011.
Notice of Opposition by Alnylam Pharmaceuticals, Inc. to European Application EP1423406, dated Jun. 1, 2011.
Notice of Opposition by Alnylam Pharmaceuticals, Inc. to European Application EP1458741, dated Jul. 16, 2013.
Notice of Opposition by Dharmacon, Inc. to European Application EP1423406, dated May 31, 2011.
Notice of Opposition by Novartis to European Application EP1423406, dated May 26, 2011.
Notice of Opposition by Sanofi to European Application EP1423406, dated May 18, 2011.
Noviello et al., "Autosomal Recessive Hypercholesterolemia Protein Interacts with and Regulates the Cell Surface Level of Alzheimer's Amyloid b Precursor Protein," The Journal of Biological Chemistry, 278, 31843-31847 (2003).
Novina et al., "siRNA-directed inhibition of HIV-1 infection," Nature Medicine, 8, 681-686 (2002).
Nykanen et al., "ATP Requirements and Small Interfering RNA Structure in the RNA Interference Pathway," Cell 107:309-321 (2001).
O'Connell et al., "Polycomblike PHD Fingers Mediate Conserved Interaction with Enhancer of Zeste Protein," The Journal of Biological Chemistry, 276, 43065-43073 (2001).
Ogris et al., "DNA/polyethylenimine transfection particles: Influence of ligands, polymer size, and PEGylation on internalization and gene expression," AAPS PharmSci., 3 (3) article 21 (http://www.pharmsci.org) p. 1-11 (2001).

(56) References Cited

OTHER PUBLICATIONS

Ohkawa et al., "Activities of HIV-RNA Targeted Ribozymes Transcribed From a 'Shot-Gun' Type Ribozyme-trimming Plasmid," Nucleic Acids Symp Ser 27:15-16 (1992).
Ojwang et al., "Inhibition of Human Immunodeficiency Virus Type 1 Expression by a Hairpin Ribozyme," Proc. Natl. Acad. Sci. USA 89:10802-10806 (1992).
Oku et al., "Real-time analysis of liposomal trafficking in tumor-bearing mice by use of positron emission tomography," Biochimica et Biophysica Acta 1238:86-90 (1995).
Olie et al., "Analysis of ribosyl-modified, mixed backbone analogs of a bcl-2/bcl-xL antisense oligonucleotide", Biochim. Biophys. Acta, vol. 1576, pp. 101-109 (2002).
Ono et al., "DNA Triplex Formation of Oligonucleotide Analogues Consisting of Linker Groups and Octamer Segments That Have Opposite Sugar-Phosphate Backbone Polarities," Biochemistry 30:9914-9921 (1991).
Opalinska et al., "A Rational Approach to Nucleic Acid Based Targeting of RNA Molecules Using Self-Quenching Reporter Molecules," Blood, 100(11):193a (2002) Abstract only.
Opalinska et al., "Nucleic-Acid Therapeutics: Basic Principles and Recent Applications," Nature Reviews Drug Discovery, (1 ):503-514 (2002).
Opponents' Briefs Filed in Opposition to European Patent App. 03743684.7 dated Jul. 6, 2011.
Pal-Bhadra et al., "Heterochromatic Silencing and HP1 Localizatin in *Drosophila* are Dependent on the RNAi Machinery," Science, 303, 669-672 (2004).
Pallis et al., "P-glycoprotein in Acute Myeloid Leukaemia: Therapeutic Implications of its Association with Both a Multidrug-resistant and an Apoptosis-resistant Phenotype," Leukemia and Lymphoma, 43 (6), 1221-1228 (2002).
Pan et al., "Probing of tertiary interactions in RNA: 2'-Hydroxyl-base contacts between the Rnase P and pre-tRNA," Proc. Natl. Acad. Sci. USA 92:12510-12514 (1995).
Pardridge et al., "Vector-mediated delivery of a polyamide ("peptide") nucleic acid analogue through the blood-brain barrier in vivo," Proc. Natl. Acad. Sci. USA 92:5592-5596 (1995).
Parrish et al., "Functional Anatomy of a dsRNA Trigger: Differential Requirement for the Two Trigger Strands in RNA Interference," Molecular Cell 6: 1077-1087 (2000).
Patentee's Briefs Filed in Opposition to European Patent App. 03743684.7 dated Nov. 9, 2011.
Paul et al., "Effective Expression of Small Interfering RNA in Human Cells," Nature Biotechnology 20:505-508 (2002).
Perreault et al., "Mixed Deoxyribo- and Ribo-Oligonucleotides with Catalytic Activity," Nature 344:565-567 (1990) (often mistakenly listed as Perrault).
Perrotta and Been, "A pseudoknot-like structure required for efficeint self-cleavage of hepatitis delta virus RNA," Nature 350:434-436 (1991).
Perrotta and Been, "Cleavage of Oligoribonucleotides by a Ribozyme Derived from the Hepatitis 8 Virus RNA Sequence," Biochemistry 31:16-21 (1992).
Petersen et al., "Polyethylenimine-graft-Poly(ethylene glycol) Copolymers: Influence of Copolymer Block Structure on DNA Complexation and Biological Activities as Gene Delivery System," Bioconjugate Chem., 13, 845-854 (2002).
Pilone, "D-Amino acid oxidase: new findings," Cellular and Molecular Life Sciences, vol. 57, 1732-1747 (2000).
Player and Torrence, "The 2-5A System: Modulation of Viral and Cellular Processes Through Acceleration of RNA Degradation," Pharmacal Ther. 78:55-113 (1998).
Ponpipom et al., "Cell-Specific Ligands for Selective Drug Delivery to Tissues and Organs," J. Med. Chem. 24:1388-1395 (1981).
Prakash et al., "Positional Effect of Chemical Modifications on Short Interference RNA Activity in Mammalian Cells," J. Med. Chem. 48: 4247-4253 (2005).

Praseuth et al., "Triple helix formation and the antigene for sequence-specific control of gene expression," Biochimica et Biophysica Acta 1489:181-206 (1999).
Preat et al., "Topical delivery of nucleic acids in skin," S.T.P. Pharma Sciences, 11 (1) 57-68 (2001).
Puttaraju et al., "A circular trans-acting hepatitis delta virus ribozyme," Nucleic Acids Research 21:4253-4258 (1993).
Qu et al., "Selective Inhibition of IL-2 Gene Expression by IL-2 Antisense Oligonucleotides Blocks Heart Allograft Rejection," Transplantation, 72, 5, 915-923 (2001).
Rajakumar et al., "Effects of Intrastriatal Infusion of D2 Receptor Antisense Oligonucleotide on Apomorphine-Induced Behaviors in the Rat," Synapse 26:199-208 (1997).
Randall et al., "Clearance of replicating hepatitis C virus by small interfering RNAs," Proceedings of the National Academy of Sciences of USA, 1 00(1) Abstract only (2003).
Ray et al., "Common Signaling Themes," Science, 306, 1505 (2004).
Regnier et al., "Parameters Controlling Topical Delivery of Oligonucleotides by Electroporation," Journal of Drug Targeting, 5(4 ), 275-289 (1998).
Reichert et al., "Interleukin-2 expression in human carcinoma cell lines and its role in cell cycle progression," Oncogene, 19, 514-525 (2000).
Reid et al., "The human multidrug resistance protein MRP4 functions as a prostaglandin efflux transporter and is inhibited by nonsteroidal anti-inflammatory drugs," PNAS, 1 00(16):9244-9249 (2003).
Reinhart and Bartel, "Small RNAs Correspond to Centromer Heterochromatic Repeats," Science 297:1831 (2002).
Reinhart et al., "MicroRNAs in Plants," Genes & Development 16:1616-1626 (2002).
Reply of the patent proprietor to the notice(s) of opposition (dated Mar. 19, 2014, from European Application EP1458741).
Reply of the patent proprietor to the notice(s) of opposition (dated Nov. 9, 2011, from European Application EP1423406).
Reynolds et al., "Rational siRNA designe for RNA intereference," Nature Biotechnology, 22, 3, 326-330 (2004) [also referred to as 1 Feb. 4, 2004, doi: 10.1 038/nbt936].
Richardson and Schepartz, "Tethered Oligonucleotide Probes. A Strategy for the Recognition of Structured RNA," J. Am. Chem. Soc. 113:5109-5111 (1991).
Robertson et al., "Purification and Properties of a Specific *Escherichia coli* Riobnuclease which Cleaves a Tyrosine Transfer Ribonucleic Acid Precursor," J Biol. Chem. 247:5243-5251 (1972).
Rossi et al., "Ribozymes as Anti-HIV-1 Therapeutic Agents: Principles, Applications, an Problems," Aids Research and Human Retroviruses 8:183-189 (1992).
Saenger (ed), "Modified Nucleosides and Nucleotides; Nucleoside Di- and Triphosphates; Coenzymes and Antibiotics, (ch.7)" Principles of Nucleic Acid Structure 158-200 (1984).
Salo et al., "Aminooxy Functionalized Oligonucleotides: Preparation, On-Support Derivatization, and Postsynthetic Attachment to Polymer Support," Bioconjugate Chem. 10:815-823 (1999).
Sanghvi et al., "Improved Process for the Preparation of Nucleosidic Phosphoramidites Using a Safer and Cheaper Activator," Organic Process Res. & Dev. 4:175-181 (2000).
Santoro and Joyce, "A general purpose RNA-cleaving DNA enzyme," Proc. Natl. Acad. Sci. USA 94:4262-4266 (1997).
Santoro et al., "Mechanism and Utility of an RNA-Cleaving DNA Enzyme," Biochemistry 37:13330-13342 (1998).
Santoro et al., "RNA Cleavage by a DNA Enzyme with Extended Chemical Functionality," J. Am. Chem. Soc. 122:2433-2439 (2000).
Hegg et al., "Kinetics and Thermodynamics of Intermolecular Catalysis by Hairpin Ribozymes," Biochemistry 34:15813-15828 (1995).
Herrmann et al., "Comparative analysis of adenoviral transgene delivery via tail or portal vein into rat liver," Arch Virol149:1611-1617 (2004).
Hertel et al., "A Kinetic Thermodynamic Framework for the Hammerhead Ribozyme Reaction," Biochemistry 33:3374-3385 (1994).

(56) References Cited

OTHER PUBLICATIONS

Hirotsune et al., "An expressed Pseudogene regulates the messenger-RNA stability of its homologous coding gene," Nature, 423, 91-96 (2003).
Hofland and Huang, "Formulation and Delivery of Nucleic Acids," Handbook of Exp. Pharmacol. 137:165-192 (1999).
Hohjoh et al., "RNA interference (RNAi) induction with various types of synthetic oligonucleotides duplexes in cultured human cells," FEBS Letters 521: 195-199 (2002).
Holen et al., "Positional effects of short interfering RNAs targeting the human coagulation trigger Tissue Factor," Nucleic Acids Research, 30:8, 1757-1766 (2002).
Hornung et al., "Sequence-specific potent induction of IFN-.alpha. by short interfering Rna in plasmacytoid dendritic cells through TLR7," Nature Medicine, 11, 263-270 (2005).
Hsia et al., "Relationship Between Chemotherapy Response of Small Cell Lung Cancer and P-glycoprotein or Multidrug Resistance-Related Protein Expression," Lung, 180:173-179 (2002).
Hu et al., "Inhibition of Retroviral Pathogenesis by RNA Interference", 2002, Current Biology, vol. 12, pp. 1301-1311.
Hu et al., "The Radioresistance to Killing of a 1-5 Cells Derives from Activation of the Chk1 Pathway," The Journal of Biological Chemistry, 276, 17693-17698 (2001).
Hunziker et al., "Nucleic Acid Analogues: Synthesis and Properties, in Modern Synthetic Methods," VCH, 331-417.
Hussain et al., "Identification of a Novel Aspartic Protease (Asp 2) as b-Secretase," Molecular and Cellular Neuroscience, 14, 419-427 (1999).
Hutvagner and Zamore, "A MicroRNA in a Multiple-Turnover RNAi Enzyme Complex," Science 297:2056-2060 (2002).
Hutvagner et al., "A Cellular Function for the RNA-Interference Enzyme Dicer in the Maturation of the let-7 Small Temporal RNA," Science 293:834-838 (2001).
International Preliminary Report on Patentability for Application No. PCTUS2011057663 dated Feb. 14, 2012.
International Search Report for Application No. PCTUS2011057663 dated Feb. 14, 2012.
International Search Report for PCT/US02/15876 dated Apr. 4, 2007.
International Search Report for PCT/US03/02510 dated May 30, 2003.
International Search Report for PCT/US03/03473 dated Aug. 19, 2003.
International Search Report for PCT/US03/03662 dated Sep. 5, 2003.
International Search Report for PCT/US03/04034 dated Aug. 5, 2003.
International Search Report for PCT/US03/04088 dated Jul. 11, 2003.
International Search Report for PCT/US03/04123 dated Jun. 22, 2004.
International Search Report for PCT/US03/04250 dated Dec. 19, 2003.
International Search Report for PCT/US03/04347 dated Oct. 30, 2003.
International Search Report for PCT/US03/04397 dated Jun. 2, 2003.
International Search Report for PCT/US03/04402 dated Nov. 20, 2003.
International Search Report for PCT/US03/04448 dated Dec. 22, 2003.
International Search Report for PCT/US03/04464 dated Jan. 13, 2004.
International Search Report for PCT/US03/04566 dated May 27, 2003.
International Search Report for PCT/US03/04710 dated Nov. 18, 2003.
International Search Report for PCT/US03/04738 dated Dec. 10, 2003.
International Search Report for PCT/US03/04741 dated Jul. 16, 2004.
International Search Report for PCT/US03/04907 dated Dec. 11, 2003.
International Search Report for PCT/US03/04908 dated Oct. 20, 2003.
International Search Report for PCT/US03/04909 dated Mar. 18, 2005.
International Search Report for PCT/US03/04951 dated Feb. 19, 2004.
International Search Report for PCT/US03/05022 dated Jan. 6, 2005.
International Search Report for PCT/US03/05028 dated Oct. 17, 2003.
International Search Report for PCT/US03/05043 dated Jan. 16, 2004.
International Search Report for PCT/US03/05044 dated Jul. 2, 2004.
International Search Report for PCT/US03/05045 dated Sep. 14, 2004.
International Search Report for PCT/US03/05162 dated Sep. 17, 2003.
International Search Report for PCT/US03/05190 dated Nov. 4, 2003.
International Search Report for PCT/US03/05234 dated Apr. 8, 2004.
International Search Report for PCT/US03/05326 dated Nov. 14, 2003.
International Search Report for PCT/US03/05346 dated Oct. 17, 2003.
Saville and Collins, "A Site-Specific Self-Cleavage Reaction Performed by a Novel RNA in Neurospora Mitochondria," Cell 61:685-696 (1990).
Saville and Collins, "RNA-Mediated Ligation of Self-Cleavage Products of a Neurospora Mitochondrial Plasmid Transcript," Proc. Natl. Acad. Sci. USA 88:8826-8830 (1991).
Scanlon et al., "Ribozyme-Mediated Cleavage of c-fos mRNA Reduces Gene Expression of DNA Synthesis Enzymes and Metallothionein," Proc. Natl. Acad. Sci. USA 88:10591-10595 (1991).
Scaringe et al., "Chemical synthesis of biologically active oligoribonucleotides using .beta.-cyanoethyl protected ribonucleoside phosphoramidites," Nucl Acids Res. 18:5433-5441 (1990).
Scherr et al., "Specific inhibition of bcr-abl gene expression by small interfering RNA," Blood, 1 01 :4, 1566-1569 (2003).
Schmajuk et al., "Antisense Oligonucleotides with Different Backbones," The Journal of Biological Chemistry 274:21783-21789 (1999).
Schmidt et al., "Base and sugar requirements for RNA cleavage of essential nucleoside residues in internal loop B of the hairpin ribozyme: implications for secondary structure," Nucleic Acids Research 24:573-581 (1996).
Schroeder et al., "Diffusion Enhancement of Drugs by Loaded Nanoparticles in Vitro," Prog. Neuro-Psychopharmacol. & Biol. Psychiat. 23:941-949 (1999) [sometimes cited by RPI as Prog Neuropsychopharmacol Biol Psychiatry 23:941-949, 1999].
Schwarz et al., "Asymmetry in the Assembly of the RNAi Enzyme Complex," Cell, 1115, 199-208 (2003).
Scott et al., "The crystal structure of an All-RNA hammerhead ribozyme: A proposed mechanism for RNA catalytic cleavage," Cell 81: 991-1002 (1995).
Seela and Kaiser, "Oligodeoxyribonucleotides containing 1,3-propanediol as nucleoside substitute," Nucleic Acids Research 15:3113-3129 (1987).
Semizarov, et al., "siRNA-mediated gene silencing: a global genome view," Nucleic Acids research, 32(13): 3836-3845 (2004).
Sethupathy et al., "TarBase: A comprehensive database of experimentally supported animal microRNA targets," RNA, 12:192-197 (2006).
Shabarova et al., "Chemical ligation of DNA: The first non-enyzmatic assembly of a biologically active gene," Nucleic Acids Research 19:4247-4251 (1991).
Sharp, "RNAi and double-strand RNA," Genes & Development, 13:139-141 (1999).

(56) References Cited

OTHER PUBLICATIONS

Sheehan et al., "Biochemical properties of phosphonoacetate and thiophosphonoacetate oligodeoxyribonucleotides," Nucleic Acids Research, 31 (14), 4109-4118 (2003).
Shieh et al., "The human homologs of checkpoint kinases Chk1 and Cds1 (Chk2) phosphorylate p53 at multiple DNA damage-inducible sites," Genes & Development, 14:289-300 (2000).
Silverman et al., "Selective RNA Cleavage by Isolated RNase L Activated with 2-5A Antisense Chimeric Oligonucleotides," Methods in Enzymology 313:522-533 (1999).
Simantov et al., "Dopamine-Induced Apoptosis in Human Neuronal Cells: Inhibition by Nucleic Acids Antisense to the Dopamine Transporter," Neuroscience 74(1):39-50 (1996).
Sioud and Leirdal, "Design of Nuclease Resistant Protein Kinase Ca DNA Enzymes with Potential Therapeutic Application," J. Mol. Biol., 296, 937-947 (2000).
Sirois et al., "Anitsense Oligonucleotide Inhibition of PDGFR-p Receptor Subunit Expression Directs Suppression of Intimal Thickening," Circulation, 95:669-676 (1997).
Smith et al., "The GLH proteins, Caenorhabditis elegans P Granule Componments, Associate with CSN-5 and KGB-1, Proteins Necessary for Fertility, and with ZYX-1, a Predicted Cytoskeletal Protein," Developmental Biology, 251, 333-347 (2002).
Sommer et al., "The Spread and Uptake Pattern of Intracerebrally Administered Oligonucleotides in Nerve and Glial Cell Populations of the Rat Brain," Antisense & Nucleic Acid Drug Development 8:75-85 (1998).
Stein and Cheng, "Antisense Oligonucleotides as Therapeutic Agents—is the Bullet Really Magical?" Science 261:1004-1288 (1993).
Stein et al., "A Specificity Comparison of Four Antisense Types: Morpholino, 2'-0-Methyl RNA, DNA, and Phosphorothioate DNA," Antisense & Nucleic Acid Drug Development 7:151-157 (1997).
Strauss, Evelyn, "Molecular Biology: Candidate 'Gene Silencers' Found," Molecular Biology, vol. 286, No. 5441, p. 886 (1999) (sometimes mistakenly referred to as being published in Science].
Strobel and Dervan, "Site-Specific Cleavage of a Yeast Chromosome by Oligonucleotide-Directed Triple-Helix Formation," Science 249:73-75 (1990).
Sullenger et al., "Overexpression of TAR Sequences Renders Cells Resistant to Human Immunodeficiency Virus Replication," Cell 63:601-608 (1990).
Svoboda et al., "Selective reduction of dormant maternal mRNAs in mouse oocytes by RNA interference," Development, 127,4147-4156 (2000).
Szostak, "In Vitro Genetics," TIBS 17:89-93 (1993).
Table 1 of application as submitted in US proceedings for European Application EP1423406.
Takagi et al., "Mechanism of action of hammerhead ribozymes and their applications in vivo: rapid identification of functional genes in the post-genome era by novel hybrid ribozyme libraries," Biochemical Society Transactions, 30, 1145-1149 (2002) [abstract only].
Tang et al., "Examination of the catalytic fitness of the hammerhead ribozyme by in vitro selection," RNA 3:914-925 (1997).
Tari et al., "Growth Inhibition of breast cancer cells by Grb2 downregulation is correlated with inactivation of mitogen-activated protein kinase in EGFR, but not in ErbB2, cells" Oncogene 18:1325-1332 (1999).
Tari et al., "Inhibition of Grb2 and Crkl Proteins Results in Growth Inhibition of Philadelphia Chromosome Positive Leukemic Cells." Biochem and Biophys Research Comm 235: 383-388 (1997).
Tavemarakis et al., "Heritable and inducible genetic interference by double-stranded RNA encoded by transgenes," Nature Genetics 24, 180-183 (2000).
Thomas et al., "Enhancing polyethylenimine's delivery of plasmid DNA into mammalian cells," PNAS, 99, 14640-14645 (2002).
Thomson et al., "Activity of hammerhead ribozymes containing non-nucleotidic linkers," Nucleic Acids Research 21:5600-5603 (1993) (May be Referred to as Thompson).
Tuschl et al., "Small Interfering RNAs: A Revolutionary Tool for Analysis of Gene Function and Gene Therapy," Molecular Interventions, 2, 3, 158-167 (2002).
Tuschl et al., "Targeted mRNA Degradation by Double-Stranded RNA In Vitro," Genes & Development 3191-3197 (1999).
Tuschl, "RNA Interference and Small Interfering RNAs," Chembiochem 2:239-245 (2001).
Tyler et al., "Peptide nucleic acids targeted to the neurotensin receptor and administered i.p. cross the blood-brain barrier and specifically reduce gene expression," Proc Natl Acad. Sci. USA 96:7053-7058 (1999).
Tyler et al., "Specific gene blockade shows that peptide nucleic acids readily enter neuronal cells in vivo," FEBS Letters 421:280-284 (1998).
U.S. Appl. No. 14/458,578, filed Aug. 13, 2014.
Ueda et al., "The Human Multidrug Resistance (mdr1) Gene," The Journal of Biological Chemistry, 262 (2), 505-508 (1987).
Uhlmann and Peyman, "Antisense Oligonucleotides: A New Therapeutic Principle," Chemical Reviews 90:544-584 (1990).
Ui-Tei et al., "Guidelines for the selection of highly effective siRNA sequences for mammalian and chick RNA interference," Nucleic Acids Research, 32, 3, 936-948 (2004) [also referred to as doi:1 0.1 093/nar/gkh247].
Ullrich et al., "Insulin-like growth factor I receptor primary structure: comparison with insulin receptor suggests structural determinants that define functional specificity," The EMBO Journal, 5:10, 2503-2512 (1986).
Usman and Cedergren, "Exploiting the chemical synthesis of RNA," TIBS 17:334-339 (1992).
Abramovitz et al., "Catalytic Role of 2'-Hydroxyl Groups Within a Group II Intron Active Site," Science 271:1410-1413 (1996).
Adah et al., "Chemistry and Biochemistry of 2, 5-Oligoadenylate-Based Antisense Strategy," Current Medicinal Chemistry, 8, 1189-1212 (2001).
Agrawal, "Importance of Nucleotide Sequence and Chemical Modifications of Antisense Oligonucleotides", Biochimica et Biophysica Acta, vol. 1489:53-68, (1999).
Akhtar and Juliano, "Cellular Uptake and Intracellular Fate of AntiSense Oligonucleotides," Trends Cell Biol. 2:139-144 (1992).
Aldrian-Herrada et al., "A peptide nucleic acid (PNA) is more rapidly internalized in cultured neurons when coupled to a retro-inverso delivery peptide. The antisense activity depresses the target mRNA and protein in magnocellular oxytocin neurons," Nucleic Acids Research 26:4910-4916 (1998).
Alexeev et al., "Localized in vivo genotypic and phentypic correction of the albino mutation in skin by RNA-DNA oligonucleotide," Nature Biotechnology, 18:43-47 (2000).
Allerson et al., "Fully 2'-Modified Oligonucleotide Duplexes with Improved in Vitro Potency and Stability Compared to Unmodified Small Interfering RNA," J Med. Chem., 48:901-904 (2005).
Allshire, "RNAi and Heterochromatin—A Hushed-up Affair," Science 297:1818-1819 (2002).
Almendral et al., "Cloning and Sequence of the Human Nuclear Protein Cyclin: Homology with DNA-binding Protein," Proc Natl Acad Sci., 84:1575-1579 (1987).
Amarzguioui et al. "Tolerance for mutations and chemical modifications in a siRNA," Nucl. Acids. Res. 31:589-595 (2003).
Anderson et al., "Bispecific short hairpin siRNA constructs targeted to CD4 CXCR4, and CCR5 confer HIV-1 resistance," Oligonucleuotides, vol. 13, No. 5, pp. 303-312 (2003).
Andrews and Faller, "A rapid micropreparation technique for extraction of DNA-binding proteins from limiting numbers of mammalian cells," Nucleic Acids Research 19:2499 (1991).
Annex to the communication-opposition (dated Oct. 7, 2013, from European Application EP1423406).
Antopolsky et al., "Peptide-Oligonucleotide Phosphorothioate Conjugates with Membrane Translocation and Nuclear Localization Properties," Bioconjugate Chem. 10:598-606 (1999).
Arap et al., "Cancer Treatment by Targeted Drug Delivery to Tumor Vasculature in a Mouse Model," Science 279:377-380 (1998).
Baenziger and Fiete, "Galactose and N-Acetylgalactosamine-Specific Endocytosis of Glycopeptides by Isolated Rat Hepatocytes," Cell 22:611-620 (1980).

(56) References Cited

OTHER PUBLICATIONS

Bahramian et al., "Transcriptional and Posttranscriptional Silencing of Rodent a1 (I) Collagen by a Homologous Transcriptionally Self-Silenced Transgene," Molecular and Cellular Biology, vol. 19 No. 1, pp. 274-283 (1999).
Bannai et al., "Effect of Injection of Antisense Oligodeoxynucleotides of GAD Isozymes into Rat Ventromedial Hypothalamus on Food Intake and Locomotor Activity," Brain Research 784:305-315 (1998).
Bannai et al., "Water-absorbent Polymer as a Carrier for a Discrete Deposit of Antisense Oligodeoxynucleotides in the Central Nervous System," Brain Research Protocols 3:83-87 (1998).
Basi et al., "Antagonistic Effects of b-Site Amyloid Precursor Prtein-cleaving Enzymes 1 and 2 on b-Amyloid Peptide Production in Cells," The Journal of Biological Chemistry, 278, 31512-31520 (2003).
Bass et al., "RNA interference: The short answer," Nature 411: 428-429 (2001).
Bass, "Double-Stranded RNA as a Template for Gene Silencing," Cell, 101, 235-238 (2000).
Bass, "RNA editing and hypermutation by adenosine deamination," TIBS 22(5): 157-162 (1997).
Bauer, Paul H. et al., "Discrimination Between Sialic Acid-Containing Receptors and Pseudoreceptors Regulates Polyomavirus Spread in the Mouse", Journal of Virology, Jul. 1999, p. 5826-5832.
Bayard et al., "Increased stability and antiviral activity of 2'-0-phosphoglyceryl derivatives of (2'-5')oligo(adenylate)," Eur. J. Biochem., 142(29):291-298 (1984).
Beaucage and Iyer, "The Functionalization of Oligonucleotides Via Phosphoramidite Derivatives," Tetrahedron 49:1925-1963 (1993).
Beigelman et al., "Chemical Modification of Hammerhead Ribozymes," The Journal of Biological Chemistry 270:25702-25708 (1995).
Bellon et al., "4-Thio-oligo-.beta.-D-ribonucleotides: synthesis of .beta.-4'-thio-oligouridylates, nuclease resistance, base pairing properties, and interaction with HIV-1 reverse transcriptase," Nucleic Acids Research, 21(7):1587-1593 (1993).
Bernstein et al., "Role for a Bidentate Ribonuclease in the Initiation Step of RNA Interference," Nature 409:363-366 (2001).
Bernstein et al., "The rest is silence," RNA, 7:1509-1521 (2001).
Bertrand et al., "Comparison of antisense oligonucleotides and siRNAs in cell culture and in vivo", BBRC, vol. 296, pp. 1000-1004 (2002).
Berzai-Herranz et al., "Essential nucleotide sequences and secondary structure elements of the hairpin ribozyme," EMBO J. 12:2567-2574 (1993).
Bettinger et al., "Size Reduction of Galactosylated PEI/DNA Complexes Improves Lectin-Mediated Gene Transfer into Hepatocytes," Bioconjugate Chem., 10, 558-561 (1999).
Bitko et al., "Phenotypic silencing of cytoplasmic genes using sequence-specific double-stranded short interfering RNA and its application in the reverse genetics of wild type negative-strand RNA viruses," BMC Microbiology, 1:34 (2001).
Boado et al., "Drug Delivery of Antisense Molecules to the Brain for Treatment of Alzheimer's Disease and Cerebral AIDS," Journal of Pharmaceutical Sciences 87:1308-1315 (1998).
Boado, "Antisense drug delivery through the blood-brain barrier," Advanced Drug Delivery Reviews 15:73-107 (1995).
Bonora et al., "Biological Properties of Antisense Oligonucleotides Conjugated to Different High-Molecular Mass Poly (ethylen glycols)," Nucleosides & Nucleotides 18:1723-1725 (1999).
Bonora et al., "Synthesis and Characterization of High-Molecular Mass Polyethylene Glycol-Conjugated Oligonucleotides," Bioconjugate Chern. 8:793-797 (1997).
Braasch et al., "Novel antisense and peptide nucleic acid strategies for controlling gene expression", Biochem. 41(14):4503-4510 (2002).
Braasch et al., "RNA Inteference in Mammalian Cells by Chemically-Modified RNA," Biochemistry, 42, 7967-7975 (2003).
Brand, "Topical and transdermal delivery of antisense oligonucleotides," Curr. Opin. Mol. Ther., 3(3):244-248 (2001) [Abstract Only].
Breaker et al., "A DNA enzyme with Mg2+-dependent RNA phosphoesterase activity," Chemistry & Biology 2(10):655-660 (1995).
Breaker, "Are engineered proteins getting competition from RNA?" Current Opinion in Biotechnology 7:442-448 (1996).
Broaddus et al., "Distribution and stability of antisense phosphorothioate oligonucleotides in rodent brain following direct intraparenchymal controlled-rate infusion," J Neurosurg 88:734-742 (1998).
Brody and Gold, "Aptamers as therapeutic and diagnostic agents," Reviews in Molecular Biotechnology 74:5-13 (2000).
Brummelkamp et al. "A System for Stable Expression of Short Interfering RNAs in Mammalian Cells," (2002) Science 296:550-553.
Buckwold et al., "Effects of a Naturally Occurring Mutation in the Hepatitis B Virus Basal Core Promoter on Precore Gene Expression and Viral Replication," Journal of Virology, vol. 70(9), 5845-5851 (1996).
Caplen et al., "Specific inhibition of gene expression by small double-stranded RNAs in invertebrate and vertebrate systems", Proc. Natl. Acad. Sci., vol. 98, pp. 9742-9747 (2001).
Caplen, "RNAi as a gene therapy approach," Expert Opin. Biol. Ther., 3(4):575-586 (2003).
International Search Report for PCT/US03/07273 dated Oct. 27, 2003.
International Search Report for PCT/US03/18911 dated Nov. 19, 2003.
International Search Report for PCT/US2004/012517 dated Sep. 28, 2005.
International Search Report for PCT/US2004/016390 dated Mar. 31, 2005.
International Search Report for PCT/US2004/030488 dated Jan. 12, 2005.
International Search Report for PCT/US2006/032168 dated Jun. 6, 2007.
Ishiwata et al., "Physical-Chemistry Characteristics and Biodistribution of Poly(ethylene glycoi)-Coated Liposomes Using Poly(oxyethylene) Cholesteryl Ether," Chem. Pharm. Bull. 43:1005-1011 (1995) (mistakenly referred to as Ishiwataet).
Izant and Weintraub, "Constitutive and Conditional Suppression of Exogenous and Endogeneous Genes by Anti-Sense RNA," Science 229:345-352 (1985).
Jacque et al., "Modulation of HIV-1 replication by RNA interference." Nature 418: 435-438 (2002).
Janowski et al., "Inhibitng gene expression at transcription start sites inchromosomal DNA with antigene RNAs", Nature Chemical Biology, 1, 216-222 (2005).
Jaschke et al., "Automated Incorporation of Polyethylene Glycol into Synthetic Oligonucleotides," Tetrahedron Letters 34:301-304 (1993) (sometimes mistakenly referred as to Jschke).
Jaschke et al., "Synthesis and Properties of Oligodeoxyribonuclotide-polyethylene Glycol Conjugates," Nucleic Acids Research 22:4810-4817 (1994).
Jaschke, "Oligonucleotide-Poly(ethylene glycol) Conjugates: Synthesis, Properties, and Application," American Chemical Society 680:265-283 (1997).
Jayasena, "Aptamers: An Emerging Class of Molecules that Rival Antibodies in Diagnostics," Clinical Chemistry 45:1628-1650 (1999).
Jen et al., "Suppression of gene Expression by Targeted Disruption of Messenger RNA: Available Options and Current Strategies," Stem Cells, 18:307-319(2000).
Jenuwein, "An RNA-Guided Pathway for the Epigenome," Science 297:2215-2218 (2002).
Jiang et al., "Grb2 Regulates Internalization of EGF Receptors through Clthrin-coated Pits," Molecular Biology of the Cell, 14:858-870 (2003).
Joliiet-Riant and Tillement, "Drug transfer across the blood-brain barrier and improvement of brain delivery," Fundam. Clin. Pharmacol. 13:16-26 (1999).
Judge et al., "Sequence-dependent stimulation of the mammalian innate immune response by synthetic siRNA," Nature Biotechnology, 23(4):457-462 (2005).
Kanikkannan, "Iontophoresis-Based Transdermal Delivery Systems," Biodrugs, 16(5):339-347 (2002).

(56) References Cited

OTHER PUBLICATIONS

Kapadia et al., "Interference of hepatitis C virus RNA replication by short interfering RNAs," Proceedings of the National Academy of Sciences of USA, National Academy of Science, Washington, US, 100(4):2014-2018 (2003).

Karle et al., "Differential Changes in Induced Seizures After Hippocampal Treatment of Rats with an Antisense Oligodeoxynucleotide to the GABAA Receptor gamma.2 Subunit," Euro. Jour. of Pharmacology 340:153-160 (1997).

Karpeisky et al., "Highly Efficient Synthesis of 2'-0-Amino Nucleosides and Their Incorporation in Hammerhead Ribozymes," Tetrahedron Letters 39:1131-1134 (1998).

Kawasaki et al., "siRNAs generated by recombinant human Dicer induce specific and significant but target site-independent gene silencing in human cells," Nucleic Acids Research, 31 (3 ):981-987 (2003).

Kawasaki et al., "Uniformly Modified 2'-Modified 2'-Deoxy-2'-fluoro Phosphorothioate Oligonucleotides as Nuclease-Resistant Antisense Compounds with High Affinity and Specificity for RNA Targets," J. Med. Chem., 36, 831-841 (1993).

Kennerdell et al., "Heritable gene silencing in *Drosophila* using double-stranded RNA," Nature Biotech 18: 896-898 (2000).

Kim et al., "A Conserved p38 MAP Kinase Pathway in Caenorhabditis elegans Innate Immunity," Science, 297, 623-626 (2002).

Koike et al., "Thimet Oligopeptidase Cleaves the Full-Length Alzheimer Amyloid Precursor Protein at a b-Secretase Cleavage Site in COS Cells," J. Biochem., 126, 235-242 (1999).

Kraynack et al., "Small interfering RNAs containing full 2'-O-methylribonucleotide-modified sense strands display Argonaute2/eIF2C2-dependent activity," RNA 12: 163-176 (2006).

Kunath et al., "The structure of PEG-modified poly(ethylene imines) influences biodistribution and pharmacokinetics of their complexes with NF-kappaB decoy in mice.," Medline (Pharm Res.) 19(6): 810-817 (Jun. 1, 2002).

Kurreck et al., Design of antisense oligonucleotides stabilized by locked nucleic acids, 2002, Nucleic Acids Research, vol. 30, No. 9, pp. 1911-1918.

Kusser, "Chemically modified nucleic acid aptamers for in vitro selections: evolving evolution," Reviews in Molecular Biotechnology 74:27-38 (2000).

Kuwabara et al., "Activities of tRNA-embedded dimeric minizymes," Nucleic Acids Symposium Series No. 37, 307-308 (1997).

L'Huillier et al., "Cytoplasmic Delivery of Ribozymes Leads to Efficient Reduction in a-Lactalbumin mRNA Levels in C1271 Mouse," EMBO J. 11:4411-4418 (1992).

Laible et al., "Mammalian homologues of the Polycomb-group gene Enhancer of zeste mediate gene silencing in *Drosophila heterochromatin* and at *S.cervisiae telomeres*," The EMBO Journal, 16, 3219-3232 (1997).

Lasic and Needham "The 'Stealth' Liposome: A Prototypical Biomaterial," Chemical Reviews 95:2601-2627 (1995).

Lasic and Papahadjopoulos, "Liposomes Revisited," Science 267:1275-1276 ( 1995).

Lee and Larson, "Modified Liposome Formulations for Cytosolic Delivery of Macromolecules," ACS Symposium Series 752:184-192 (2000).

Lee and Lee, "Preparation of Cluster Glycosides of N-Acetylgalactosamine That Have Subnanomolar Binding Constants Towards the Mammalian Hepatic Gal/GalNAc-specific Receptor," Glycoconjugates J, 4.317-328 (1987).

Lee et al., "Enhancing the Catalytic Repertoire of Nucleic Acids: A Systematic Study of Linker Length and Rigidity," Nucleic Acids Research 29:1565-1573 (2001).

Lee et al., "Expression of Small Interfering RNA's Targeted Against HIV-1 rev Transcripts in Human Cells," Nature Biotechnology 19:500-505 (2002).

Leirdal et al., "Gene silencing in mammalian cells by preformed small RNA duplexes," Biochemical and Biophysical Research Communications, 295: 744-748 (2002).

Letter regarding the opposition procedure (no time limit) (dated Jan. 29, 2014, from European Application EP1423406).

Letter regarding the opposition procedure (no time limit) (dated Jan. 31, 2014, from European Application EP1423406).

Letter regarding the opposition procedure (no time limit) (dated Sep. 10, 2013, from European Application EP1423406).

Li and Altman, "Cleavage by RNase P of gene N mRNA reduces bacteriophage A burst size," Nucleic Acids Research 24:835-842 (1996).

Lichner et al., "Double-stranded RNA-binding proteins could suppress RNA interference-mediated antiviral defences," Journal of General Virology, 84, 975-980 (2003).

Limbach et al., "Summary: the modified nucleosides of RNA," Nucleic Acids Research 22(12):2183-2196 (1994).

Lin et al., "A Novel mRNA-cRNA Interference Phenomenon for Silencing bcl-2 Expression in Human LNCaP Cells," Biochemical and Biophysical Research Communications, 281, 639-644 (2001).

\* cited by examiner

B —————— $N_{X3}$ —————— $(N)_{X2}$ B -3'

B $(N)_{X1}$ —————— $N_{X4}$ —————— $[N]_{X5}$ -5'

| $N_{X3}$ Y/R | $N_{X4}$ Y/R | $[N]_{X5}$ Y/R |
|---|---|---|
| (5+) 2'-F/OH Optional PS | (5+) 2'-F/OH Optional PS | 2'-OH/OH or 2'-OMe/OH or 2'-F/OH + Optional PS |
| (5+) 2'-OMe/OH Optional PS | (5+) 2'-OMe/OH Optional PS | |
| (5+) 2'-F/H Optional PS | (5+) 2'-F/OMe Optional PS | |
| (5+) 2'-OMe/F Optional PS | (5+) 2'-F/OMe Optional PS | |

$(N)_{X1}$ = 2'-OMe/F/H/LNA + Optional PS $(N)_{X2}$ = 2'-OM/F/H/LNA + Optional PS

| $N_{X3}$ Y/R | $N_{X4}$ Y/R |
|---|---|
| (5+) 2'-F/OH Optional PS | (5+) 2'-F/OH Optional PS |
| (5+) 2'-OMe/OH Optional PS | (5+) 2'-OMe/OH Optional PS |
| (5+) 2'-F/H Optional PS | (5+) 2'-F/OMe Optional PS |
| (5+) 2'-OMe/F Optional PS | (5+) 2'-F/OMe Optional PS |

| [N3]-[N2]-[N1] |
|---|
| 2'-H, 2'-F, 2'-F or 2'-OMe, 2'-F, 2'-F or 2'-F, 2'-F, 2'-F or 2'-H, 2'-F, 2'-F |

$(N)_{X1}$ = 2'-OMe/F/H/LNA + Optional PS
$(N)_{X2}$ = 2'-OM/F/H/LNA + Optional PS n = 0, 1, 2, 3, 4

Figure 5C 1. 5'- B-NNNNNNNNNN(NN)-B -3'
2. 3'- B-(NN)NNNNNNNNN<u>N</u>N₃N₂N₁ -5'
3. 5'- - - - - - [NN]NNNNNNNNNNNNNNNN - - - - - - -3'

↑ 11th nucleotide position based on 5'-end of antisense strand

Figure 7: Phosphorylated siNA constructs

Figure 8: 5'-phosphate modifications

Figure 9: Cholesterol Conjugate Approach

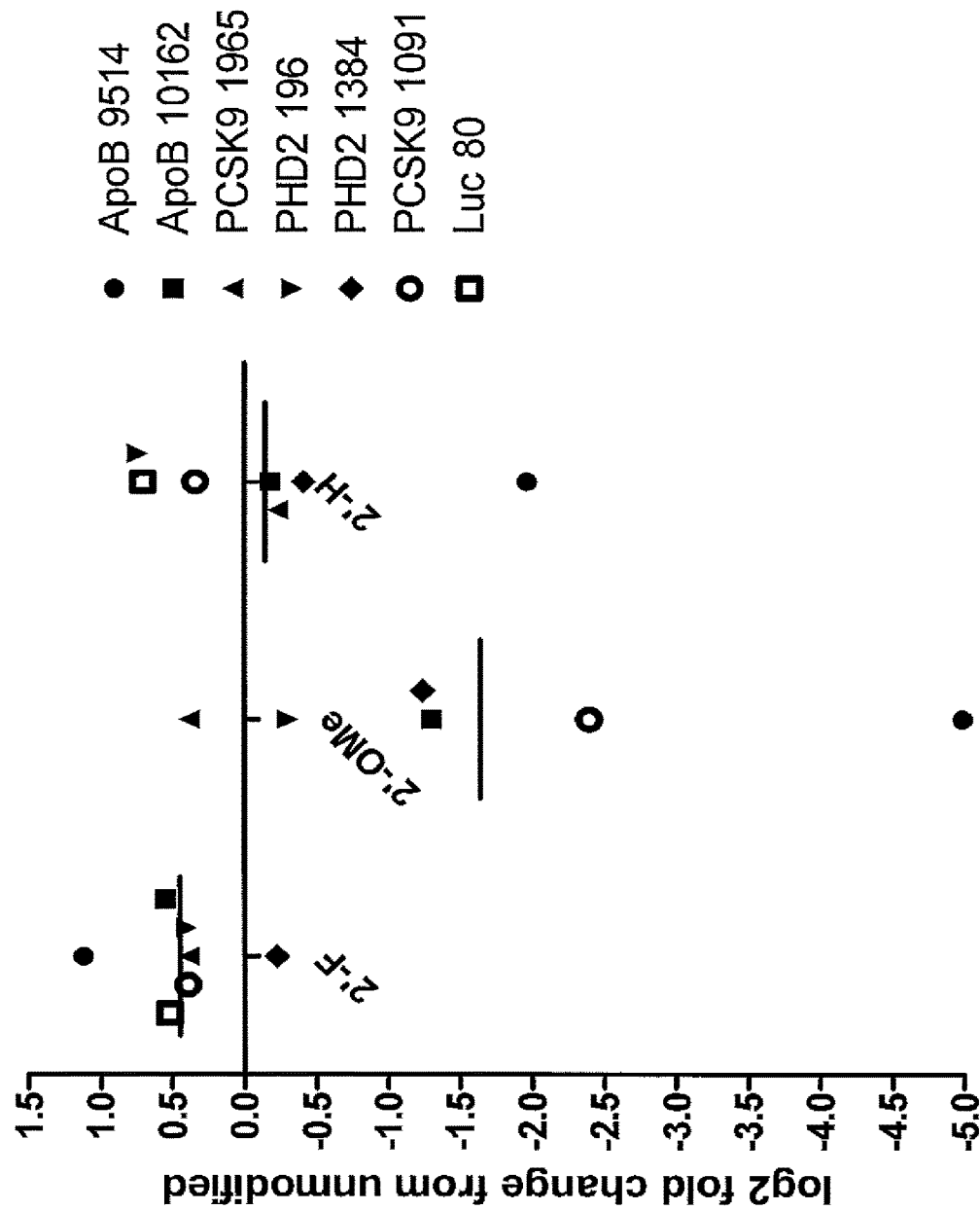

RNA INTERFERENCE MEDIATED INHIBITION OF GENE EXPRESSION USING SHORT INTERFERING NUCLEIC ACIDS (siNA)

This application is a continuation of U.S. patent application Ser. No. 17/510,277, filed on Oct. 25, 2021, which is a continuation of U.S. patent application Ser. No. 15/947,248, filed Apr. 6, 2018, now U.S. Pat. No. 11,193,126, issued on Dec. 7, 2021, which is a continuation of U.S. patent application Ser. No. 14/984,065, filed Dec. 30, 2015, now U.S. Pat. No. 9,970,005, issued on May 15, 2018, which is a continuation of U.S. patent application Ser. No. 13/881,415, filed May 10, 2013, now U.S. Pat. No. 9,260,471, issued on Feb. 16, 2016, which is a National Stage Entry of PCT Application No. PCT/US2011/057663, filed Oct. 25, 2011, which claims the benefit of U.S. Provisional Patent Application No. 61/408,428 filed Oct. 29, 2010 and U.S. Provisional Patent Application No. 61/408,303 filed Oct. 29, 2010. The entire contents of each of the foregoing applications are incorporated herein by reference.

REFERENCE TO SEQUENCE LISTING

The instant application contains a Sequence Listing which has been submitted electronically in XML format and is hereby incorporated by reference in its entirety. Said XML copy, created on Mar. 29, 2024, is named 121301-18307_SL.XML and is 3,048.737 bytes in size.

FIELD OF THE INVENTION

The present invention relates to compounds, compositions, and methods for the study, diagnosis, and treatment of traits, diseases and conditions that respond to the modulation of gene expression and/or activity. The present invention is also directed to compounds, compositions, and methods relating to traits, diseases and conditions that respond to the modulation of expression and/or activity of genes involved in gene expression pathways or other cellular processes that mediate the maintenance or development of such traits, diseases and conditions. Specifically, the invention relates to chemically modified short interfering nucleic acid (siNA) molecules capable of mediating RNA interference (RNAi) against gene expression, including cocktails of such siNA molecules and formulations of such siNA molecules. Such siNA molecules and are useful, for example, in providing compositions to prevent, inhibit, or reduce various diseases, traits and conditions that are associated with gene expression or activity in a subject or organism.

BACKGROUND OF THE INVENTION

The following is a discussion of relevant art pertaining to RNAi. The discussion is provided only for understanding of the invention that follows. The summary is not an admission that any of the work described below is prior art to the claimed invention.

RNA interference refers to the process of sequence-specific post-transcriptional gene silencing in animals mediated by short interfering RNAs (siRNAs) (Zamore et al., 2000, Cell, 101, 25-33; Bass, 2000, Cell, 101, 235; Fire et al., 1998, Nature, 391, 806; Hamilton et al., 1999, Science, 286, 950-951; Lin et al., 1999, Nature, 402, 128-129; Sharp, 1999, genes & Dev., 13:139-141; and Strauss, 1999, Science, 286, 886). The corresponding process in plants (Heifetz et al., International PCT Publication No. WO 99/61631) is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire et al., 1999, Trends genet., 15, 358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA or viral genomic RNA.

The therapeutic potential of RNAi lies in the ability to modulate gene expression in a sequence specific manner by harnessing a highly conserved, robust endogenous mechanism of action. This endogenous mechanism of action vastly expands upon the number of available targets for disease modification when compared to existing small molecule and biologic modalities. Nevertheless, a opposed to exogenously supplied small molecule and biologic modalities, the RNA molecules that serve as triggers for RNAi are not well suited for administration due to their inherent instability, especially in biologic systems. This problem has been addressed through innovation, both in terms of chemical modification of RNA triggers (see U.S. Ser. No. 10/444,853, published as US. S Patent Appl. Publ. No. 20040192626) and various delivery approaches (see U.S. Ser. No. 11/586,102, published as US US. S. Patent Appl. Publ. No. 20080020058)), which have provided compounds and compositions available for clinical development. Nevertheless there remains a need for additional RNA triggers that are available to expand the repertoire of available compounds and compositions for use in RNAi based therapeutics, and especially compounds and compositions that are compatible with different delivery systems and/or routes of administration.

SUMMARY OF THE INVENTION

The invention provides a solution to the problem of having a sufficient repertoire of available compounds and compositions for use in RNAi based therapeutics that are compatible with different delivery modalities and/or routes of administration by providing additional forms of chemically modified short interfering nucleic acid (siNA) molecules.

The present invention provides compounds, compositions, and methods useful for modulating the expression of target genes and for treating diseases and conditions that respond to such modulation by RNA interference (RNAi). Specially, the present invention provides certain chemically modified short interfering nucleic acid (siNA) molecules for use as RNAi based therapeutic compounds and compositions.

In one embodiment, double-stranded short interfering nucleic acid (siNA) molecules are provided that modulate the expression of a target gene via RNA interference, wherein the molecule has a sense strand and an antisense strand and comprises structure represented by formula (A)

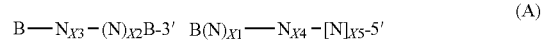

(A)

wherein, the upper strand is the sense strand and the lower strand is the antisense strand of the double-stranded nucleic acid molecule; wherein the antisense strand comprises a sequence having at least 15 nucleotides that are complementary to a target RNA sequence encoded by the target gene and the sense strand comprises a sequence that is complementarity to the antisense strand;

each N is independently a nucleotide which is unmodified or chemically modified or is optionally a non-nucleotide;

each B is independently a terminal cap that is present or absent;

(N) represents overhanging nucleotides, each of which is independently unmodified or chemically modified;

[N] represents nucleotides at the 5'-terminus of the antisense strand;

X1 and X2 are independently integers from 0 to 4;

X3 is an integer from 15 to 30;

X4 is an integer from 12 to 27; and

X5 is an integer from 1-6, provided that the sum of X4 and X5 is an integer from 15-30.

In a related embodiment, the invention features a double-stranded short interfering nucleic acid (siNA) of formula (A); wherein one or more pyrimidine nucleotides in $N_{X4}$ positions are independently 2'-deoxy-2'-fluoro nucleotides, 2'-O-alkyl nucleotides, 2'-deoxy nucleotides, ribonucleotides, or any combination thereof;

one or more purine nucleotides in $N_{X4}$ positions are independently 2'-deoxy-2'-fluoro nucleotides, 2'-O-alkyl nucleotides, 2'-deoxy nucleotides, ribonucleotides, or any combination thereof;

one or more pyrimidine nucleotides in $N_{X3}$ positions are independently 2'-deoxy-2'-fluoro nucleotides, 2'-O-alkyl nucleotides, 2'-deoxy nucleotides, ribonucleotides, or any combination thereof;

one or more purine nucleotides in $N_{X3}$ positions are independently 2'-deoxy-2'-fluoro nucleotides, 2'-O-alkyl nucleotides, 2'-deoxy nucleotides, ribonucleotides; and

[N] position nucleotide(s) are ribonucleotides, deoxyribonucleotides, 2'-O-alkyl nucleotides, 2'-halo nucleotides, or any combination thereof irrespective of purine or pyrimidine content.

In a related embodiment, the invention features a double-stranded short interfering nucleic acid (siNA) of formula (A); wherein 5, 6, 7, 8, 9, 10 or more pyrimidine nucleotides in $N_{X4}$ positions are 2'-O-alkyl nucleotides;

5, 6, 7, 8, 9, 10 or more purine nucleotides in $N_{X4}$ positions are 2'-halo nucleotides;

5, 6, 7, 8, 9, 10 or more pyrimidine nucleotides in $N_{X3}$ positions are 2'-O-alkyl nucleotides;

5, 6, 7, 8, 9, 10 or more purine nucleotides in $N_{X3}$ positions are 2'-halo nucleotides; and

[N] position nucleotide(s) are ribonucleotides, deoxyribonucleotides, 2'-O-alkyl nucleotides, 2'-halo nucleotides, or any combination thereof irrespective of purine or pyrimidine content.

In a related embodiment, the invention features a double-stranded short interfering nucleic acid (siNA) of formula (A); wherein 5, 6, 7, 8, 9, 10 or more pyrimidine nucleotides in $N_{X4}$ positions are 2'-O-methyl nucleotides;

5, 6, 7, 8, 9, 10 or more purine nucleotides in $N_{X4}$ positions are 2'-deoxy-2'-fluoro nucleotides;

5, 6, 7, 8, 9, 10 or more pyrimidine nucleotides in $N_{X3}$ positions are 2'-O-methyl nucleotides;

5, 6, 7, 8, 9, 10 or more purine nucleotides in $N_{X3}$ positions are 2'-deoxy-2'-fluoro nucleotides; and

[N] position nucleotide(s) are ribonucleotides, deoxyribonucleotides, 2'-O-alkyl nucleotides, 2'-halo nucleotides, or any combination thereof irrespective of purine or pyrimidine content.

With respect to any siNA having Formula (A) described herein, in certain embodiments, X5=3, wherein the three [N] nucleotides of formula (A) are represented as 5'-[N1, N2, N3]-3', wherein:

each N1, N2, and N3 is a ribonucleotide; or each N1, N2, and N3 is a 2'-deoxy-2'-fluoro nucleotide; or each N1, N2, and N3 is a 2'-deoxy nucleotide; or each N1, N2, and N3 is a 2'-O-alkyl nucleotide; and any of N1, N2, or N3 optionally comprises a phosphorothioate internucleotide linkage.

With respect to any siNA having Formula (A) described herein, in certain embodiments, X5=3, wherein the three [N] nucleotides of formula (A) are represented as 5'-[N1, N2, N3]-3', wherein:

N1 is a 2'-deoxy-2'-fluoro nucleotide, N2 is 2'-deoxy-2'-fluoro nucleotide, and N3 is a 2'-deoxynucleotide; and any of N1, N2, or N3 optionally comprises a phosphorothioate internucleotide linkage.

With respect to any siNA having Formula (A) described herein, in certain embodiments, X5=3, wherein the three [N] nucleotides of formula (A) are represented as 5'-[N1, N2, N3]-3', wherein:

N1 is a 2'-deoxy-2'-fluoro nucleotide, N2 is 2'-deoxy-2'-fluoro nucleotide, and N3 is a 2'-deoxy-2'-fluoro nucleotide; and any of N1, N2, or N3 optionally comprises a phosphorothioate internucleotide linkage.

With respect to any siNA having Formula (A) described herein, in certain embodiments, X5=3, wherein the three [N] nucleotides of formula (A) are represented as 5'-[N1, N2, N3]-3', wherein:

N1 is a 2'-deoxy nucleotide, N2 is 2'-deoxy-2'-fluoro nucleotide, and N3 is a 2'-alkylnucleotide; and any of N1, N2, or N3 optionally comprises a phosphorothioate internucleotide linkage.

With respect to any siNA having Formula (A) described herein, in certain embodiments, X5=3, wherein the three [N] nucleotides of formula (A) are represented as 5'-[N1, N2, N3]-3', wherein:

N1 is a 2'-deoxy nucleotide, N2 is 2'-deoxy-2'-fluoro nucleotide, and N3 is a 2'-deoxy nucleotide; and any of N1, N2, or N3 optionally comprises a phosphorothioate internucleotide linkage.

With respect to any siNA having Formula (A) described herein, in certain embodiments, the siNA molecule is covalently attached to a polymer or ligand via a linker. In certain embodiments, the siNA molecule is covalently attached to the polymer or ligand via a linker moiety at the 5'-end of the passenger (sense) strand of the siNA molecule. In other embodiments, the siNA molecule is covalently attached to the polymer or ligand via a linker moiety at the 3'-end of the passenger (sense) strand of the siNA molecule. In other embodiments, the siNA molecule is covalently attached to the polymer or ligand via a linker moiety at the 3'-end of the guide (antisense) strand of the siNA molecule. In any of the above embodiments, the linker can be attached to the terminal 3' and/or 5' nucleotide position of the passenger or guide strand, or can alternately be attached to a terminal cap moiety such as an abasic moiety or other cap as described herein or otherwise known in the art. Therefore, in totality, a siNA molecule of the invention having Forumla (A) can comprise a terminal cap (B) that includes a covalent attachment to a polymer or ligand via a linker molecule as described herein or as is otherwise known in the art. Non-limiting examples of such linkers are provided in the examples herein.

In certain embodiments, one or more terminal cap moieties of a siNA molecule of the invention (i.e. any B of any compound having Formula A herein) can comprise a delivery modality. The delivery modality can comprise a ligand or polymer that further includes one or more linker molecules. Non-limiting examples of such linker molecules include phosphate ester based linkages, amino based linkers, disulfide based linkers, succinyl based linkers, alkyl or substituted alkyl based linkers, and/or amide based linkers as are generally known in the art.

In some embodiments, the siNA molecules of the invention are phosphorylated at the 5' end of the antisense strand. The phosphate group can be a phosphate, a diphosphate or a triphosphate.

The present invention further provides compositions comprising the double-stranded nucleic acid molecules described herein with optionally a pharmaceutically acceptable carrier or diluent.

In some embodiments, the invention features a composition comprising:
 (a) a double-stranded short interfering nucleic acid (siNA) of the invention; and
 (b) a cationic lipid compond having any of compound numbers 1-46 or any combination thereof.

In some embodiments, the invention features a composition comprising:
 (a) a double-stranded short interfering nucleic acid (siNA) of the invention;
 (b) a cationic lipid compond having any of compound numbers 1-46 or any combination thereof;
 (c) cholesterol;
 (d) DSPC; and
 (e) PEG-DMG.

In some embodiments, the invention features a composition comprising:
 (a) a double-stranded short interfering nucleic acid (siNA) of the invention;
 (b) (13Z,16Z)—N,N-dimethyl-3-nonyldocosa-13,16-dien-1-amine;
 (c) cholesterol;
 (d) DSPC; and
 (e) PEG-DMG.

In some embodiments, a composition of the invention comprises a cationic lipid compond having any of compound numbers 1-46 (or any combination thereof), cholesterol, and PEG-DMG (or alternately PEG-C-DMA) in the following molar ratios:
 Cationic Lipid/Cholesterol/PEG-DMG 56.6/38/5.4;
 Cationic Lipid/Cholesterol/PEG-DMG 60/38/2;
 Cationic Lipid/Cholesterol/PEG-DMG 67.3/29/3.7;
 Cationic Lipid/Cholesterol/PEG-DMG 49.3/47/3.7;
 Cationic Lipid/Cholesterol/PEG-DMG 50.3/44.3/5.4;
 Cationic Lipid/Cholesterol/PEG-C-DMA/DSPC 40/48/2/10;
 Cationic Lipid/Cholesterol/PEG-DMG/DSPC 40/48/2/10; and
 Cationic Lipid/Cholesterol/PEG-DMG/DSPC 58/30/2/10.

In some embodiments, a composition of the invention comprises (13Z,16Z)—N,N-dimethyl-3-nonyldocosa-13,16-dien-1-amine, cholesterol, DSPC, and PEG-DMG, having a molar ratio of about 50:30:10:2 respectively.

In some embodiments, a composition of the invention further comprises a cryoprotectant. In some embodiments, the cryoprotectant is Sucrose, Trehalose, Raffinose, Stachyose, Verbascose, Mannitol, Glucose, Lactose, Maltose, Maltotriose-heptaose, Dextran, Hydroxyethyl Starch, Insulin, Sorbitol, Glycerol, Arginine, Histidine, Lysine, Proline, Dimethylsulfoxide or any combination thereof. In some embodiments, the cryoprotectant is Sucrose. In some embodiments, the cryoprotectant is Trehalose. In some embodiments, the cryoprotectant is a combination of Sucrose and Trehalose.

The present invention further provides a polymer comprising a double-stranded short interfering nucleic acid (siNA) molecule of the invention.

The present invention further provides a compound comprising a double-stranded short interfering nucleic acid (siNA) molecule of the invention covalently attached to a ligand. Non limiting examples of ligands include steroidal compounds (e.g., cholesterol), galactosamines (e.g., N-acetylgalactosamine), vitamins (e.g., folate), proteins (e.g., monoclonal antibodies), and peptides (e.g., TAT) as are generally known in the art and further provided herein.

The present invention further provides a lipid nanoparticle (LNP) composition comprising the double-stranded short interfering nucleic acid (siNA) molecule of the invention. Non-limiting examples of LNP formulations are described herein and in PCT/US11/52328, which is incorporated by reference herein in its entirely including the drawings.

The administration of the compositions of the invention can be carried out by known methods, wherein the nucleic acid is introduced into a desired target cell in vitro or in vivo.

Commonly used techniques for introduction of the nucleic acid molecules of the invention into cells, tissues, and organisms include the use of various carrier systems, reagents and vectors. Non-limiting examples of such carrier systems suitable for use in the present invention include single chemical entity conjugates, nucleic-acid-lipid particles, lipid nanoparticles (LNP), liposomes, lipoplexes, micelles, virosomes, virus like particles (VLP), nucleic acid polymers, and mixtures thereof.

The compositions of the invention can be in the form of an aerosol, dispersion, solution (e.g., an injectable solution), a cream, ointment, tablet, powder, suspension or the like. These compositions may be administered in any suitable way, e.g. orally, sublingually, buccally, parenterally, nasally, or topically. In some embodiments, the compositions are aerosolized and delivered via inhalation.

The molecules and compositions of the present invention have utility over a broad range of therapeutic applications. Accordingly another aspect of this invention relates to the use of the compounds and compositions of the invention in treating a subject. The invention thus provides a method for treating a subject, such as a human, suffering from a condition which is associated with the expression of one or more genes, wherein the method comprises administering to the subject an effective amount of a double-stranded short interfering nucleic acid (siNA) molecule of the invention. Thus, the siNA molecules of the invention treat the disease or condition. In some embodiments, the condition is one as described herein or is otherwise generally known to one of skill in the art.

Additionally, the invention provides methods for stabilizing an siNA have Formula A as defined above.

These and other aspects of the invention will be apparent upon reference to the following detailed description and attached figures. Moreover, it is contemplated that any method or composition described herein can be implemented with respect to any other method or composition described herein and that different embodiments may be combined.

Additionally, patents, patent applications, and other documents are cited throughout the specification to describe and more specifically set forth various aspects of this invention. Each of these references cited herein is hereby incorporated by reference in its entirety, including the drawings.

BRIEF DESCRIPTION OF THE DRAWINGS

In FIG. 2A, N stands for any nucleotide or optionally a non-nucleotide as described here. The upper strand, having B—$N_{X3}$—$(N)_{X2}$—B-3' is the sense (or passenger) strand of the siNA, whereas the lower strand, having B(N)$_{X1}$—$N_{X4}$—$[N]_{X5}$-5' is the antisense (or guide) strand of the siNA. Nucleotides (or optional non-nucleotides) of internal portions of the sense strand are designated $N_{X3}$ and nucleotides (or optional non-nucleotides) of internal portions of the antisense strand are designated $N_{X4}$. Nucleotides (or optional non-nucleotides) of the internal portions are generally base paired between the two strands, but can optionally lack base pairing (e.g. have mismatches or gaps) in some embodiments. Nucleotides (or optional non-nucleotides) of overhang regions are designated by parenthesis (N). Nucleotides of the 5'-terminal portion of the antisense strand are designated [N]. Terminal caps, designated as B, are optionally present at the 5' and/or 3' end of the sense strand and further optionally present at the 3'-end of the antisense strand. Generally, each strand can independently range from about 15 to about 30 nucleotides in length, but can vary depending on the presence of any overhang nucleotides. In certain embodiments, X1 and X2 are independently integers from 0 to 4; X3 is an integer from 15 to 30; X4 is an integer from 9 to 30, or 12 to 27; X5 is an integer from 0 to 6, provided that the sum of X4 and X5 is 15-30. Various modifications are shown for the nucleotides of the sense and antisense strands of the siNA constructs. The (N) overhang nucleotide positions can be chemically modified as described herein (e.g., 2'-O-methyl, 2'-deoxy-2'-fluoro, 2'-deoxy, LNA, universal bases etc.) and can be either derived from a corresponding target nucleic acid sequence or not; each (N) is independently a 2'-OMe, 2'-F, 2'-deoxy or LNA nucleotide or any combination thereof. Each N is independently a 2'-OMe, 2'-F, ribo-, or 2'-deoxy nucleotide or any combination thereof. Each [N] is independently a 2'-OMe, 2'-F, ribo-, or 2'-H nucleotide or any combination thereof. The constructs shown in the figure can also comprise phosphorothioate linkages as described herein. For example, phosphorothioate linkages can optionally exist between any N, (N), and/or [N] positions, e.g. between (N),(N); N,N; (N), N; N,[N]; or [N],[N] nucleotides. Such phosphorothioate incorporation can be utilized between purine "R" and pyrimidine "Y" positions, or for stabilization of pyrimidine linkages in general. Furthermore, although not depicted on the figure, the constructs shown in the figure can optionally include a ribonucleotide at the 9$^{th}$ position from the 5'-end of the sense strand or the 11$^{th}$ position based on the 5'-end of the guide strand by counting 11 nucleotide positions in from the 5'-terminus of the guide strand. Similarly, the antisense strand can include a ribonucleotide or a 2'-deoxy-2'-fluoro nucleotide at the 14$^{th}$ position from the 5'-end, or alternately can be selected or designed so that a 2'-O-alkyl nucleotide (e.g., a 2'-O-methyl purine) is not present at this position. Furthermore, although not shown in the figure, the 5'-terminal position of the antisense strand can comprise a terminal phosphate group as described herein. The antisense strand generally comprises sequence complementary to any target nucleic acid sequence of the invention. In FIG. 2B, N stands for any nucleotide or optionally a non-nucleotide as described herein. The upper strand, having B—$N_{X3}$—$(N)_{X2}$—B-3' is the sense (or passenger) strand of the siNA, whereas the lower strand, having B(N)$_{X1}$—$N_{X4}$—[N3]—[N2]—[N1]-5' is the antisense (or guide) strand of the siNA. Nucleotides (or optional non-nucleotides) of internal portions of the sense strand are designated $N_{X3}$ and nucleotides (or optional non-nucleotides) of internal portions of the antisense strand are designated $N_{X4}$. Nucleotides (or optional non-nucleotides) of the internal portions are generally base paired between the two strands, but can optionally lack base pairing (e.g. have mismatches or gaps) in some embodiments. Nucleotides (or optional non-nucleotides) of overhang regions are designated by parenthesis (N). Nucleotides of the 5'-terminal portion of the antisense strand are designated [N]. Terminal caps, designated as B, are optionally present at the 5' and/or 3' end of the sense strand and further optionally present at the 3'-end of the antisense strand. Generally, each strand can independently range from about 15 to about 30 nucleotides in length, but can vary depending on the presence of any overhang nucleotides. In certain embodiments, X1 and X2 are independently integers from 0 to 4; X3 is an integer from 15 to 30; and X4 is an integer from 12 to 27. Various modifications are shown for the nucleotides of the sense and antisense strands of the siNA constructs. The [N3], [N2], and [N1] nucleotides are chemically modified with either 2'-deoxy, 2'-deoxy-2'-fluoro or 2'-methoxy modifications; each [N1], [N2], [N3] is independently a 2'-OMe, 2'-F, or 2'-H nucleotide or any combination thereof. The (N) overhang nucleotide positions can be chemically modified as described herein (e.g., 2'-O-methyl, 2'-deoxy-2'-fluoro, 2'-deoxy, LNA, universal bases etc.) and can be either derived from a corresponding target nucleic acid sequence or not; each (N) is independently a 2'-OMe, 2'-F, 2'-deoxy or LNA nucleotide or any combination thereof. Each N is independently a 2'-OMe, 2'-F, ribo-, or 2'-deoxy nucleotide or any combination thereof. The constructs shown in the figure can also comprise phosphorothioate linkages as described herein. For example, phosphorothioate linkages can exist between any N, and/or (N) positions, e.g. between (N),(N); N,N; or (N),N nucleotides. Such phosphorothioate incorporation can be utilized between purine "R" and pyrimidine "Y" positions, or for stabilization of pyrimidine linkages in general. Furthermore, although not depicted on the figure, the constructs shown in the figure can optionally include a ribonucleotide at the 9$^{th}$ position from the 5'-end of the sense strand or the 11$^{th}$ position based on the 5'-end of the guide strand by counting 11 nucleotide positions in from the 5'-terminus of the guide strand. Similarly, the antisense strand can include a ribonucleotide or a 2'-deoxy-2'-fluoro nucleotide at the 14$^{th}$ position from the 5' end, or alternately can be selected or designed so that a 2'-O-alkyl nucleotide (e.g., a 2'-O-methyl purine) is not present at this position. Furthermore, although not shown in the figure, the 5'-terminal position of the antisense strand can comprise a terminal phosphate group as described herein.

FIG. 5A-C shows non-limiting examples of different siNA constructs of the invention. The criteria of the representative structures shown in FIGS. 2A, 2B, 3 and 4 can be applied to any of the structures shown in FIG. 5A-C.

Figure 1:
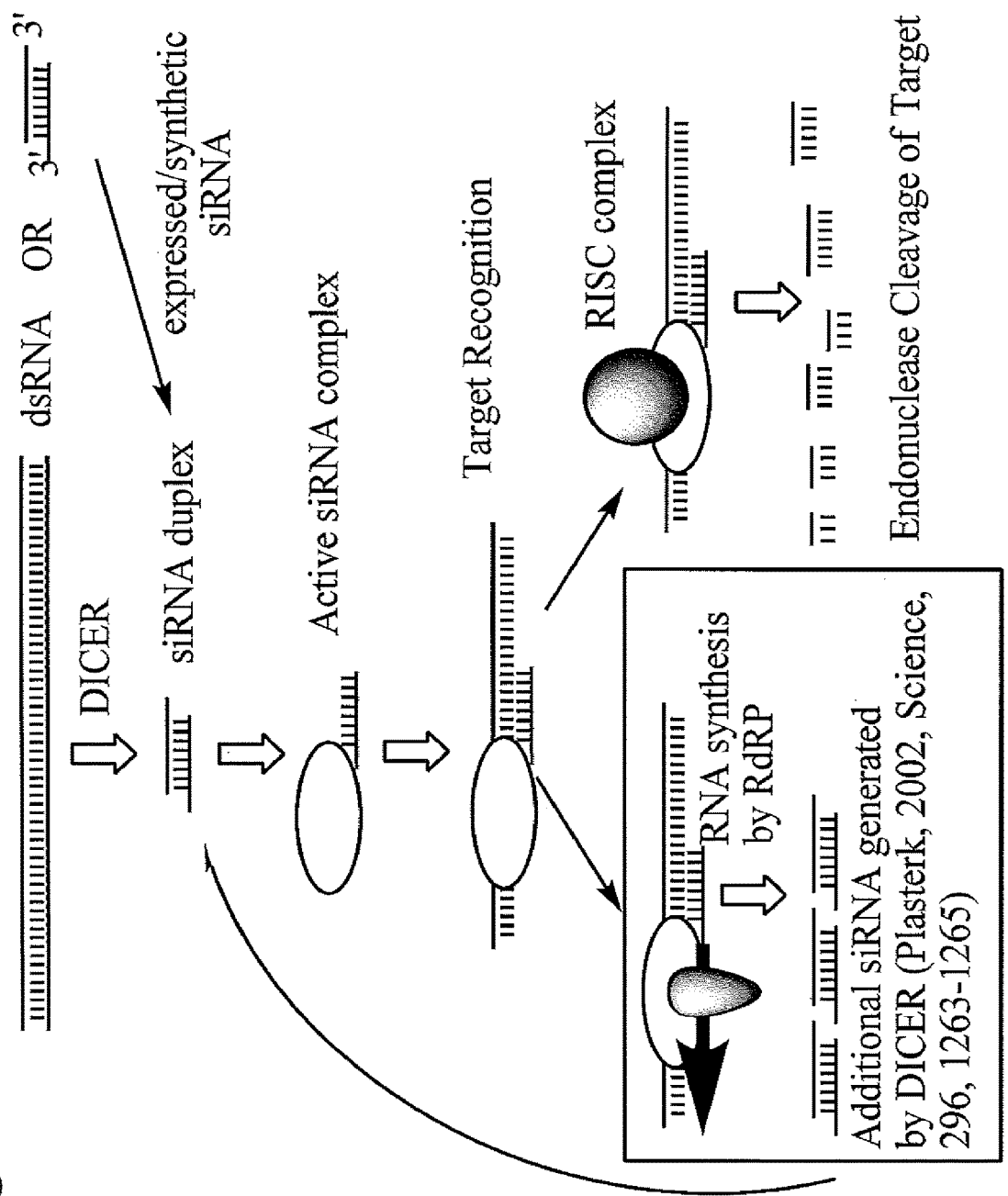
FIG. 1 shows a non-limiting proposed mechanistic representation of target RNA degradation involved in RNAi. Double-stranded RNA (dsRNA), which is generated by RNA-dependent RNA polymerase (RdRP) from foreign single-stranded RNA, for example viral, transposon, or other exogenous RNA, activates the DICER enzyme that in turn generates siNA duplexes. Alternately, synthetic or expressed siNA can be introduced directly into a cell by appropriate means. An active siNA complex forms that recognizes a target RNA, resulting in degradation of the target RNA by the RISC endonuclease complex or in the synthesis of additional RNA by RNA-dependent RNA polymerase (RdRP), which can activate DICER and result in additional siNA molecules, thereby amplifying the RNAi response.
Figure 2A:
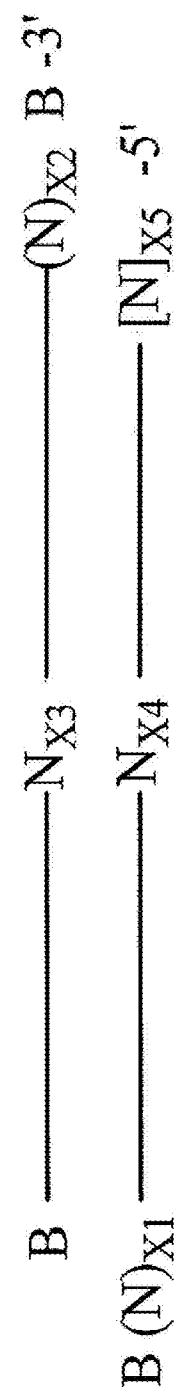
FIGS. 2A and 2B show non-limiting examples of chemically modified siNA constructs of the present invention using a generalized structure of a representative siNA duplex. The specific modifications shown in the figure can be utilized alone or in combination with other modifications of the figure, in addition to other modifications and features described herein with reference to any siNA molecule of the invention.
Figure 2B:
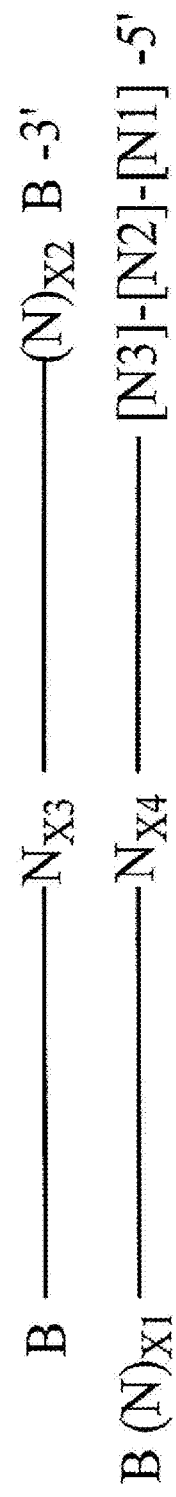
Figure 3:
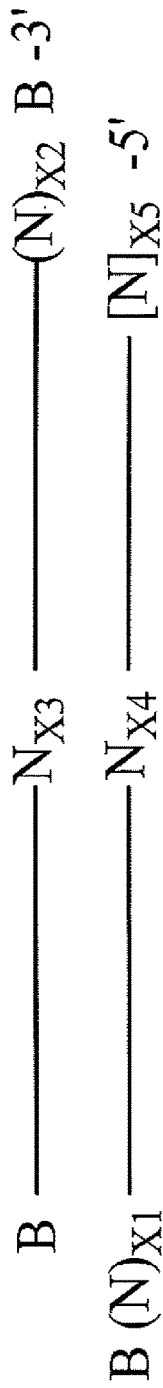
FIG. 3 shows non-limiting examples of certain combinations of modifications applied to the representative siNA duplex described in FIG. 2A. The table shown below the representative structure provides specific combinations of $(N)_{X1}$, $(N)_{X2}$, $N_{X3}$, $N_{X4}$, and/or $[N]_{X5}$ nucleotide (and optional non-nucleotide) positions. For example, combinations of 5 or more (e.g., 5, 6, 7, 8, 9, or 10 or more) $N_{X3}$ and 5 or more (e.g., 5, 6, 7, 8, 9, or 10 or more) $N_{X4}$ pyrimidine "Y" and purine "R" nucleotides are specified, each of which can independently have specific $(N)_{X1}$, and/or $(N)_{X2}$, substitutions as shown in the figure, in addition to optional phosphorothioate substitutions. The 5'-terminal antisense strand [N] nucleotides are generally ribonucleotides, but can also be modified or unmodified depending on if they are purine "R" or pyrimidine "Y" nucleotides
Figure 4:
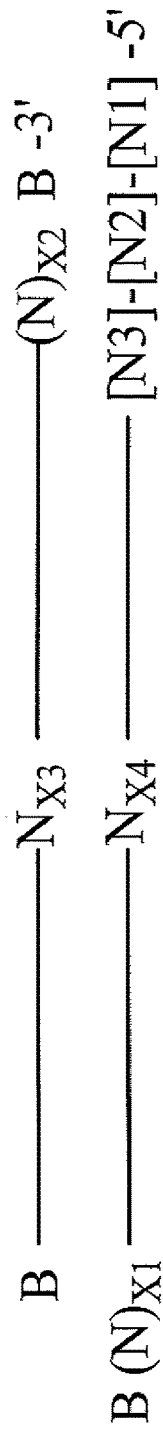
FIG. 4 shows additional non-limiting examples of certain combinations of modifications applied to the representative siNA duplex described in FIG. 2B and having specific combinations of 5'-guide strand modifications. The table shown below the representative structure provides specific combinations of $(N)_{X1}$, $(N)_{X2}$, $N_{X3}$, $N_{X4}$, and [N3]—[N2]—[N1] nucleotide (and optional non-nucleotide) positions. For example, combinations of 5 or more (e.g., 5, 6, 7, 8, 9, or 10 or more) $N_{X3}$ and 5 or more (e.g., 5, 6, 7, 8, 9, or 10 or more) $N_{X4}$ pyrimidine "Y" and purine "R" nucleotides are specified, each of which can independently have specific $(N)_{X1}$, and/or $(N)_{X2}$, substitutions as shown in the figure, in addition to optional phosphorothioate substitutions. The 5'-terminal antisense strand [N3]—[N2]—[N1]nucleotides are modified with either 2'-deoxy, 2'-deoxy-2'-fluoro or 2'-methoxy modifications as depicted.
Figure 5A:
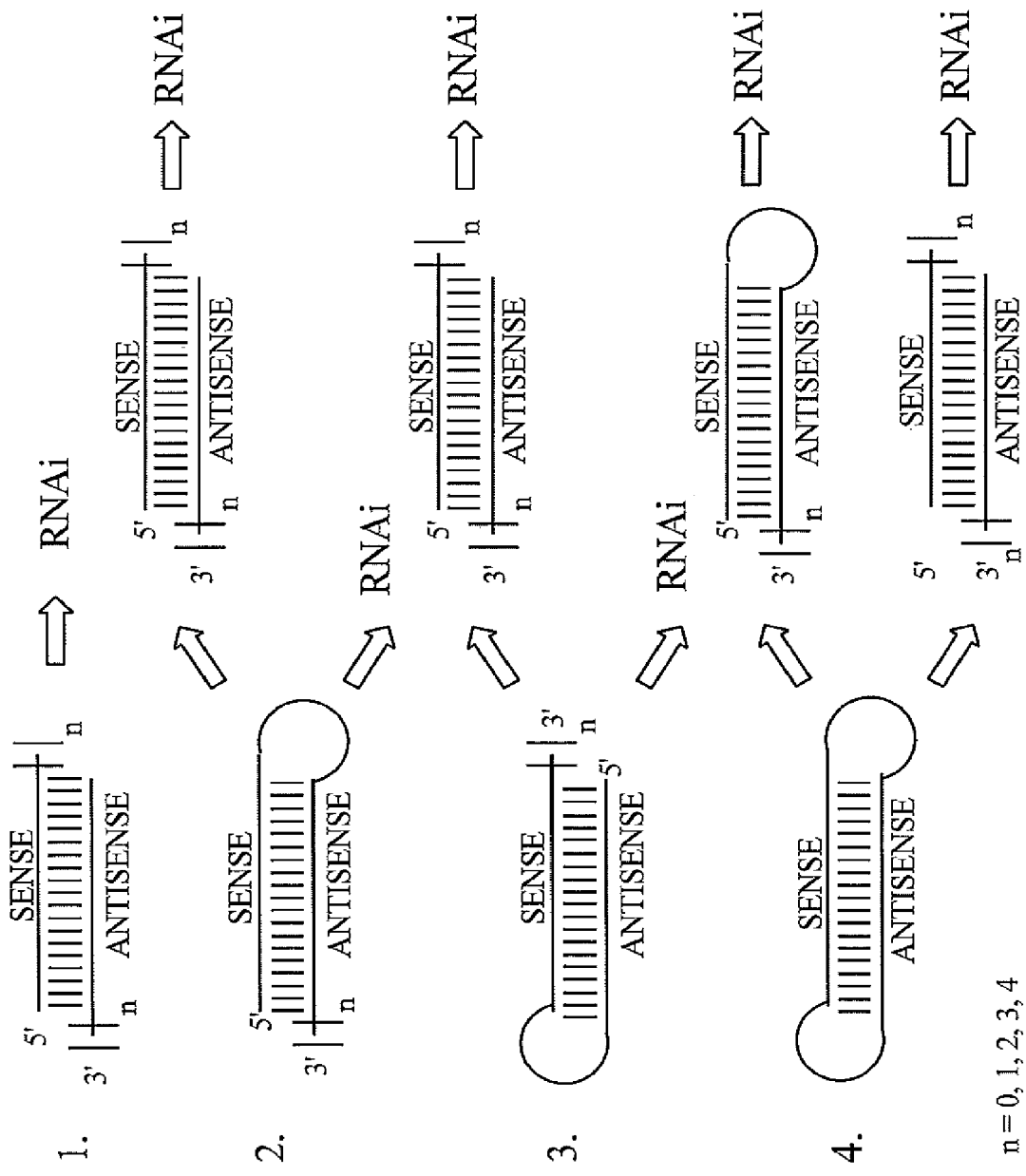

The examples shown in FIG. 5A (constructs 1, 2, and 3) have 19 representative base pairs; however, different embodiments of the invention include any number of base pairs described herein. Bracketed regions represent nucleotide overhangs, for example, comprising about 1, 2, 3, or 4 nucleotides in length, preferably about 2 nucleotides. Constructs 1 and 2 can be used independently for RNAi activity. Construct 2 can comprise a polynucleotide or non-nucleotide linker, which can optionally be designed as a biodegradable linker. In one embodiment, the loop structure shown in construct 2 can comprise a biodegradable linker that results in the formation of construct 1 in vivo and/or in vitro. In another example, construct 3 can be used to generate construct 2 under the same principle wherein a linker is used to generate the active siNA construct 2 in vivo and/or in vitro, which can optionally utilize another biodegradable linker to generate the active siNA construct 1 in vivo and/or in vitro. As such, the stability and/or activity of the siNA constructs can be modulated based on the design of the siNA construct for use in vivo or in vitro and/or in vitro.

Figure 5B:
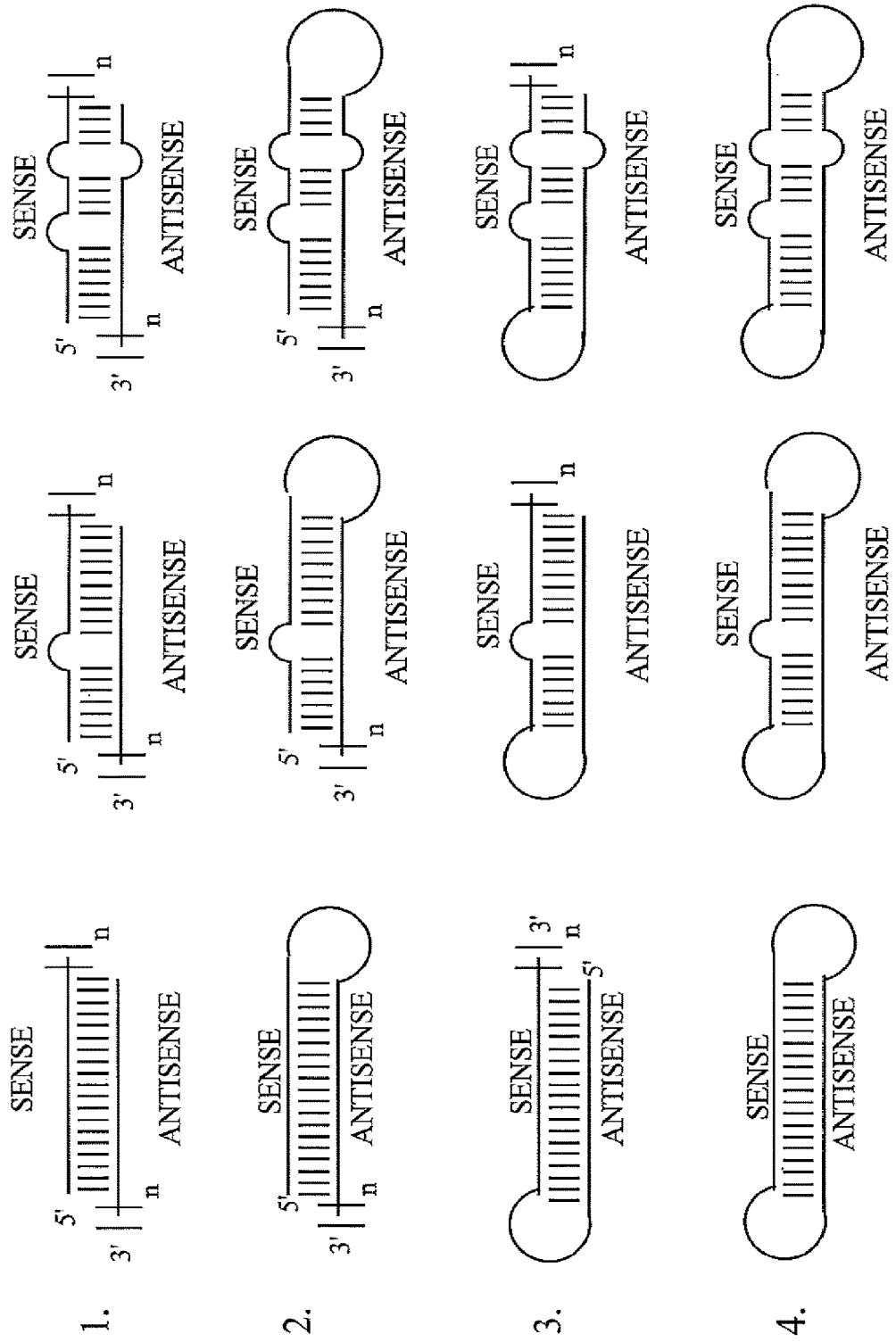

The examples shown in FIG. 5B represent different variations of double-stranded nucleic acid molecule of the invention, such as microRNA, that can include overhangs, bulges, loops, and stem-loops resulting from partial complementarity. Such motifs having bulges, loops, and stem-loops are generally characteristics of miRNA. The bulges, loops, and stem-loops can result from any degree of partial complementarity, such as mismatches or bulges of about 1, 2, 3, 4, 5, 6, 7, 8, 9, 10 or more nucleotides in one or both strands of the double-stranded nucleic acid molecule of the invention.

The example shown in FIG. 5C represents a model double-stranded nucleic acid molecule of the invention comprising a 19 base pair duplex of two 21 nucleotide sequences having dinucleotide 3'-overhangs. This generalized motif can be applied to all Stab chemistries herein (see Table 8). The top strand (1) represents the sense strand (passenger strand), the middle strand (2) represents the antisense (guide strand), and the lower strand (3) represents a target polynucleotide sequence. The guide strand is complementary to the target sequence and the passenger strand is complementary to the guide strand, except for when N of the target sequence is an A and the complementary nucleotide in the antisense strand is a U at positions 1, 2, or 3 from the 5' end of the antisense strand, and the 2'-sugar modification is a 2'-deoxy modification, a thymidine can be used in place of a 2'-deoxy uridine. Representative 2 nucleotide overhangs (NN)f are shown, but can vary, for example, from 0 to about 4 nucleotides. Terminal cap, designated as B, can be present or absent. The dinucleotide overhangs (NN) can comprise a sequence derived from the target polynucleotide. For example, the 3'-(NN) sequence in the guide strand can be complementary to the 5'-[NN] sequence of the target polynucleotide. In addition, the 5'-(NN) sequence of the passenger strand can comprise the same sequence as the 5'-[NN] sequence of the target polynucleotide sequence. In other embodiments, the overhangs (NN) are not derived from the target polynucleotide sequence, for example where the 3'-(NN) sequence in the guide strand are not complementary to the 5'-[NN] sequence of the target polynucleotide and the 5'-(NN) sequence of the passenger strand can comprise different sequence from the 5'-[NN] sequence of the target polynucleotide sequence. In additional embodiments, any (NN) nucleotides are chemically modified, e.g., as 2'-O-methyl, 2'-deoxy-2'-fluoro, and/or other modifications herein. Furthermore, the passenger strand can comprise a ribonucleotide at position N of the passenger strand. For the representative 19 base pair 21 mer duplex shown, position N can be 9 nucleotides in from the 5' end of the passenger strand. However, in duplexes of differing length, the position Nis determined based on the 5'-end of the guide strand by counting 11 nucleotide positions in from the 5'-terminus of the guide strand and picking the corresponding base paired nucleotide in the passenger strand. Cleavage by Ago2 takes place between positions 10 and 11 as indicated by the arrow. In additional embodiments, there are two ribonucleotides, NN, at positions 10 and 11 based on the 5'-end of the guide strand by counting 10 and 11 nucleotide positions in from the 5'-terminus of the guide strand and picking the corresponding base paired nucleotides in the passenger strand. The antisense strand nucleotide N can also be a ribonucleotide or modified nucleotide and is located at position 14 from the 5'-end terminus of the guide strand. The modification can be, for example, a 2'-deoxy-2'-fluoro modification, but is preferably not a 2'-O-alkyl modification. Position N3, N2, and N1 of the antisense strand can comprise modified nucleotides; N3, N2, and N1 positions of the antisense strand can have modification on the 2'-sugar position and/pr phosphate backbone.

Figure 6:
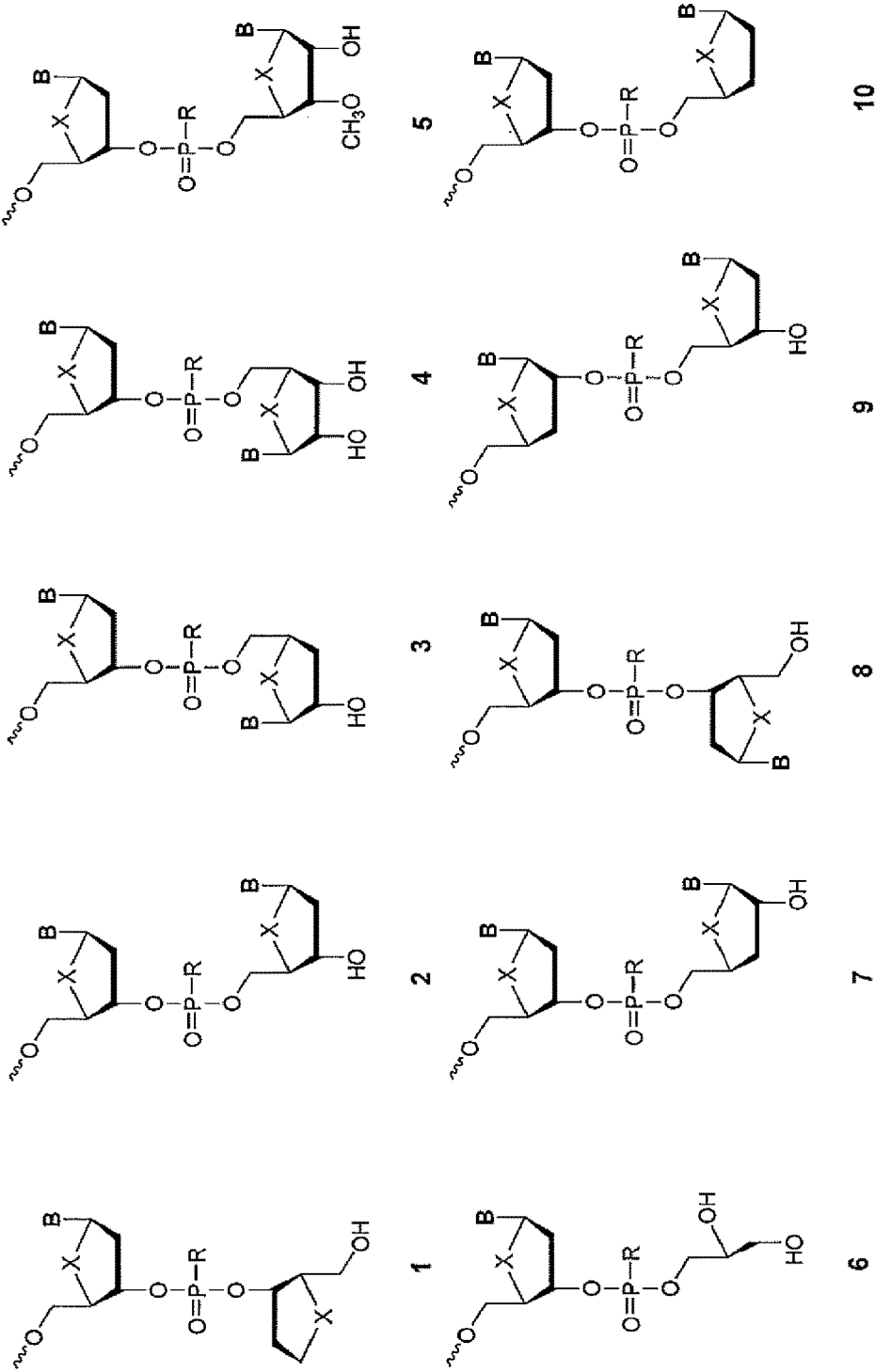

FIG. 6 shows non-limiting examples of different stabilization chemistries (1-10) that can be used, for example, to stabilize the 5' and/or 3'-ends of siNA sequences of the invention, including (1) [3-3']-inverted deoxyribose; (2) deoxyribonucleotide; (3) [5'-3']-3'-deoxyribonucleotide; (4) [5'-3']-ribonucleotide; (5) [5'-3']-3'-O-methyl ribonucleotide; (6) 3'-glyceryl; (7) [3'-5']-3'-deoxyribonucleotide; (8) [3'-3']-deoxyribonucleotide; (9) [5'-2']-deoxyribonucleotide; and (10) [5-3']-dideoxyribonucleotide (when X=O). In addition to modified and unmodified backbone chemistries indicated in the figure, these chemistries can be combined with different sugar and base nucleotide modifications as described herein.

Figure 7:
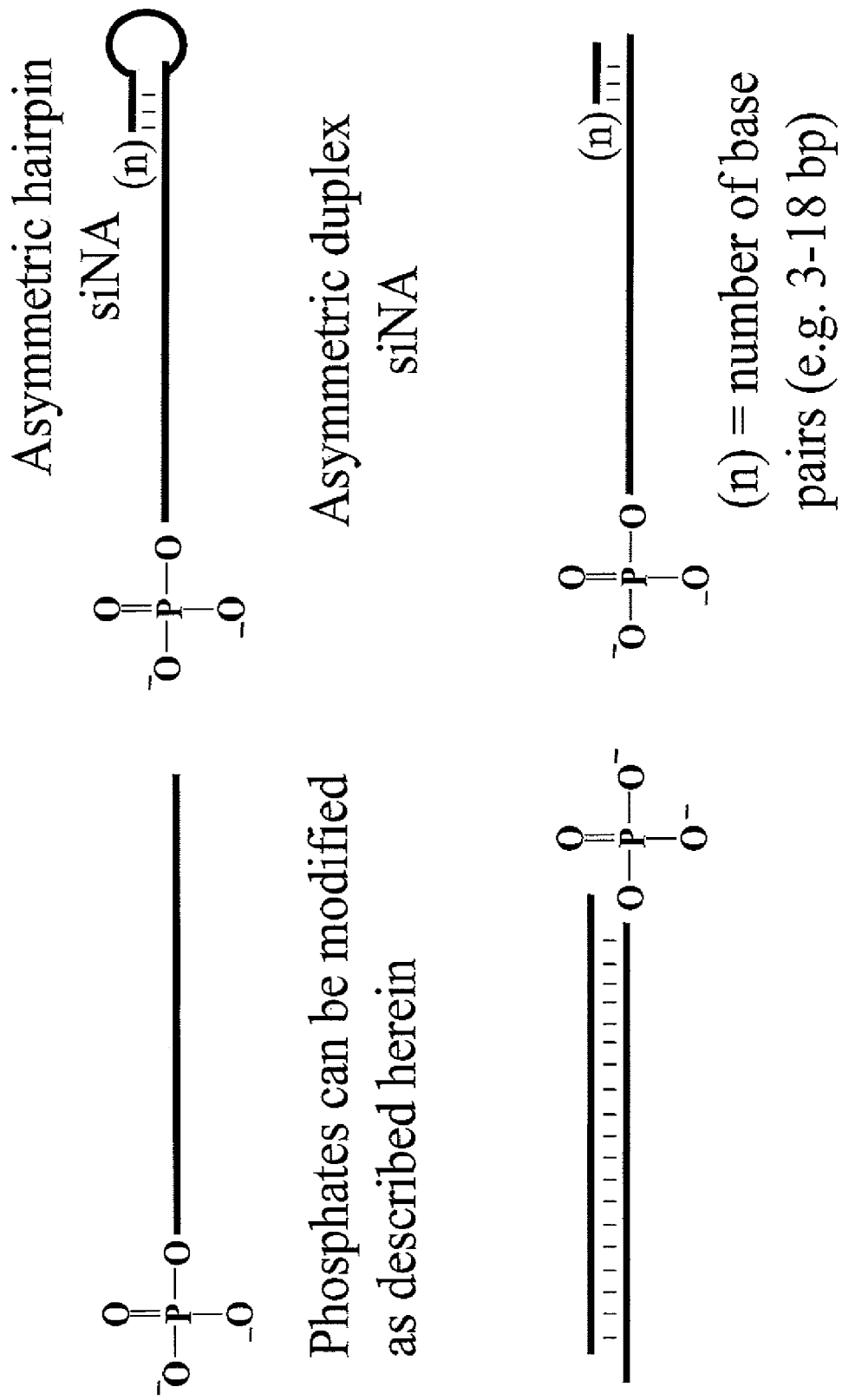

FIG. 7 shows non-limiting examples of phosphorylated siNA molecules of the invention, including linear and duplex constructs and asymmetric derivatives thereof.

Figure 8:
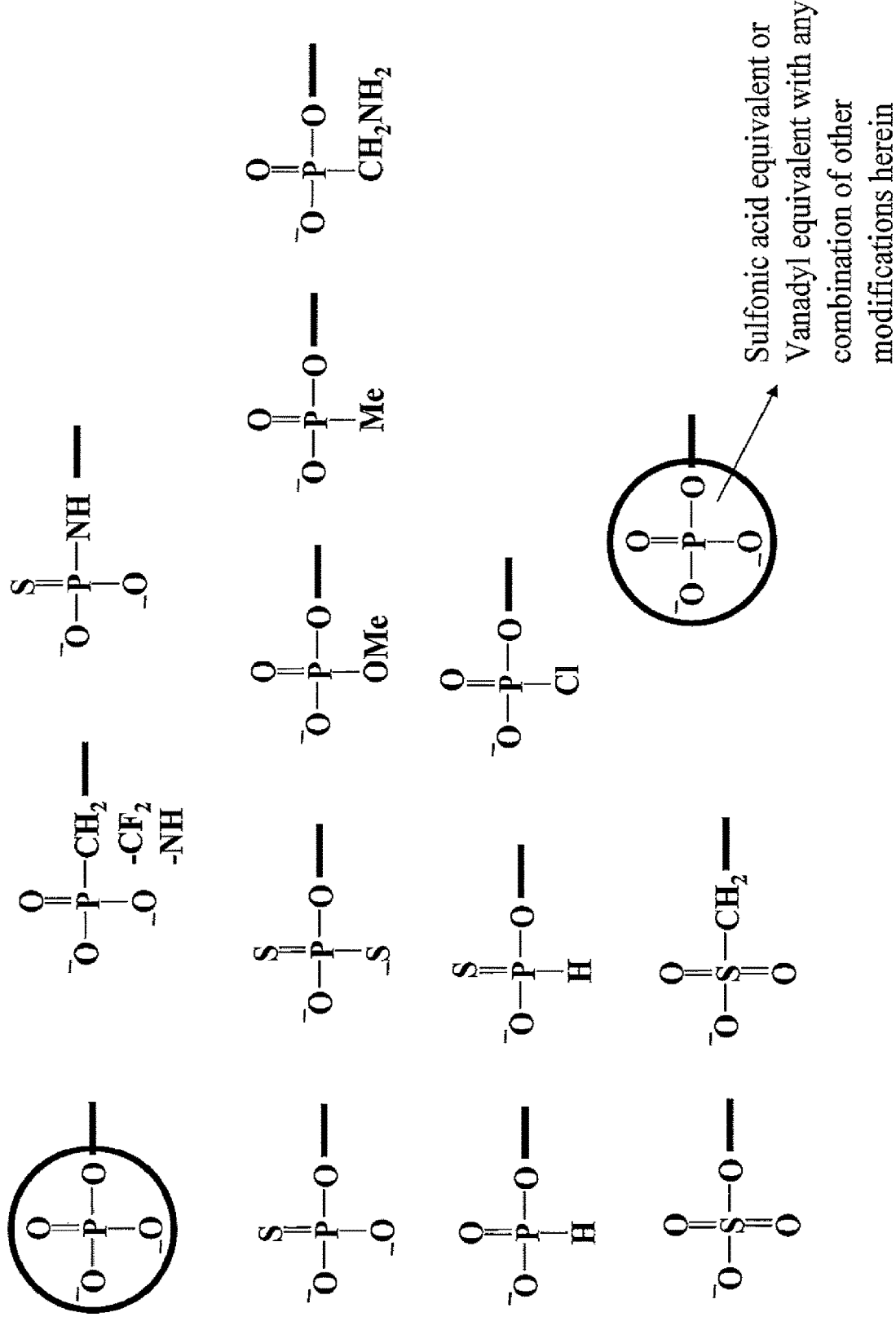

FIG. 8 shows non-limiting examples of chemically modified terminal phosphate groups of the invention.

Figure 9:
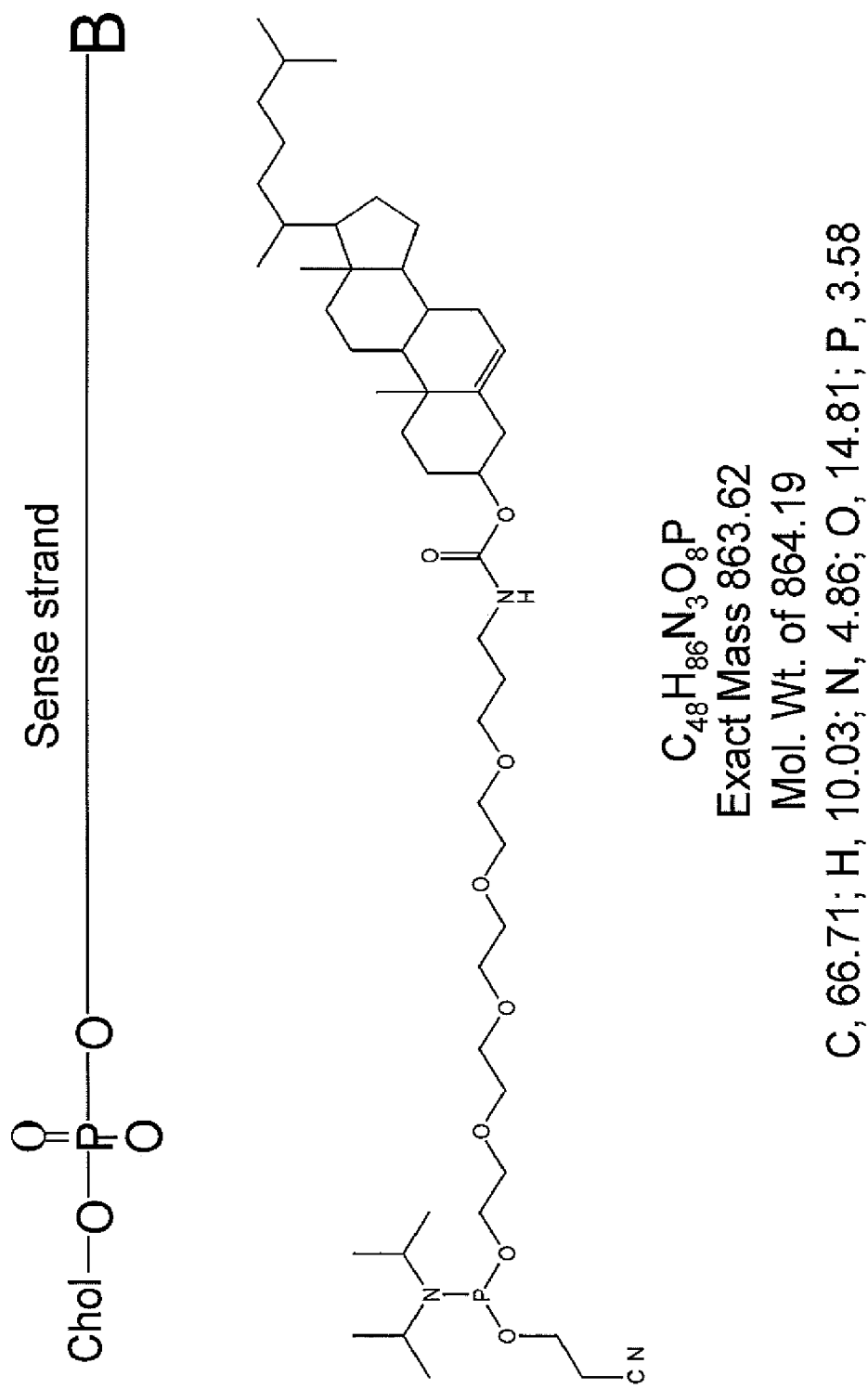

FIG. 9 shows a non-limiting example of a cholesterol linked phosphoramidite that can be used to synthesize cholesterol conjugated siNA molecules of the invention. An example is shown with the cholesterol moiety linked to the 5'-end of the sense strand of an siNA molecule.

Figure 10:
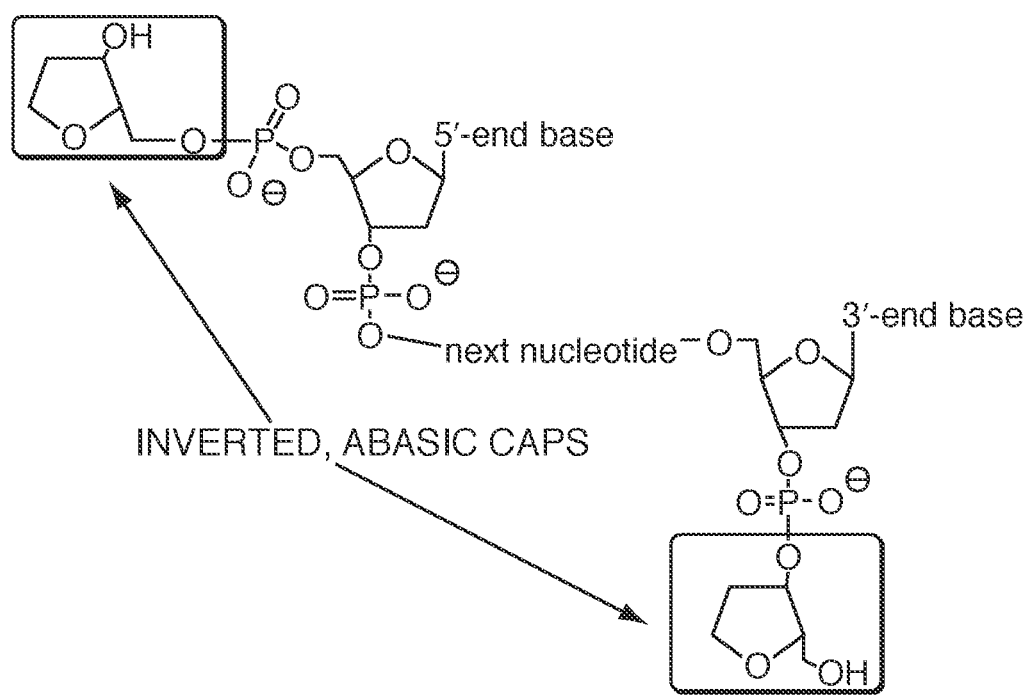

FIG. 10 depicts an embodiment of 5' and 3' inverted abasic caps linked to a nucleic acid strand. These inverted abasic caps can be derivatized with linker molecules to serve as points of attachment of the siNA molecules of the invention to polymer or ligand based delivery systems. For example, the terminal hydroxyl group present on an inverted abasic moiety, such as at the 5'-end, 3'-end, or both 5' and 5'-ends of one or both strands of the siNA molecule of the invention, can be conjugated via a linker molecule (as described herein or as otherwise known in the art) to a ligand delivery modality (e.g., a steroid such as cholesterol, an antibody, a vitamin such as folate, a galactosamine moiety such as N-acetylgalactosamine (NAG), or a peptide such as TAT) or to a polymeric delivery modality as described herein or as otherwise known in the art. Therefore, in certain embodiments, one or more terminal cap moieties of a siNA molecule of the invention (i.e. any B of a compound having Formula A herein) can comprise a delivery modality. The delivery modality can comprise a ligand or polymer that further includes one or more linker molecules (e.g., a phosphate ester based linkage, an amino based linker, a disulfide based linker, a succinyl based linker, an alkyl or substituted alkyl based linker, or an amide based linker).

Figure 11:
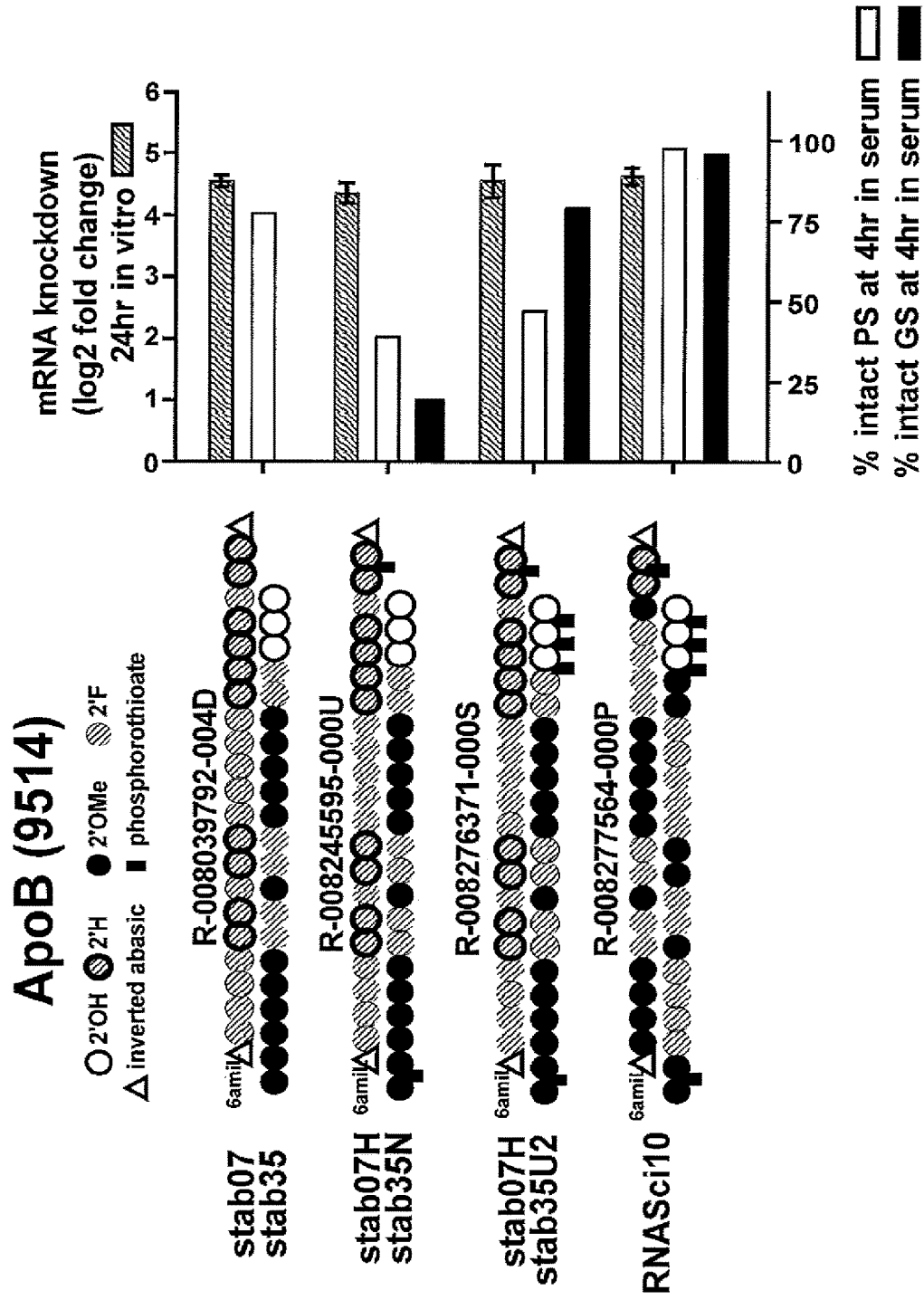

FIG. 11 depicts in vitro serum stability and mRNA knockdown at 10 nM or ApoB (9514) siRNAs with varied chemical modifications but common underlying sequence. The stab07 passenger strand is composed of 2'F (2'-deoxy-2'-fluoro) pyrimidines and 2'H (2'-deoxy) purines and contains inverted abasic caps on 5' and 3' ends. The stab07H passenger simply adds a phosphorothioate linkage between positions 20 and 21. The stab35 guide strand is unmodified at positions 1-3 with the remainder of strand composed of 2'OMe (2'-O-methyl) purines and 2'F (2'-deoxy-2'-fluoro) pyrimidines. The stab35N modification motif adds a phosphorothioate linkage between positions 20-21 while the stab35U2 motif additionally has phosphorothioate linkages at positions 1-3. The RNASci10 modification motif differs from stab07/35 motifs in that pyrimidines are 2'OMe modified while purines are 2'F. Note for all guide strands that position 14 is a 2'F regardless of pyrimidine or purine identity. See FIG. 12 for details. mRNA knockdown is measured in mouse Hepa1-6 cells using RNAiMax transfection reagent and an siRNA concentration of 10 nM. In vitro serum stability is measured by mass spectrometry and expressed as a percentage of the fully intact parental strand.

FIG. 12 depicts an evaluation of the tolerance of 2'-ribose sugar modifications at position 14 of the siRNA guide strand. 2'F, 2'OMe, and 2'H ribose modifications were tested in seven different siRNA sequences. Knockdown for individual siRNAs are shown and the horizontal line represents the median knockdown for the seven siRNAs tested. mRNA knockdown was measured as a log 2 fold-change relative to the parental unmodified siRNA sequence with negative values indicating a deleterious effect on activity. Position 14 is largely intolerant of 2'OMe substitution while 2'F is best tolerated.

Figure 13A:
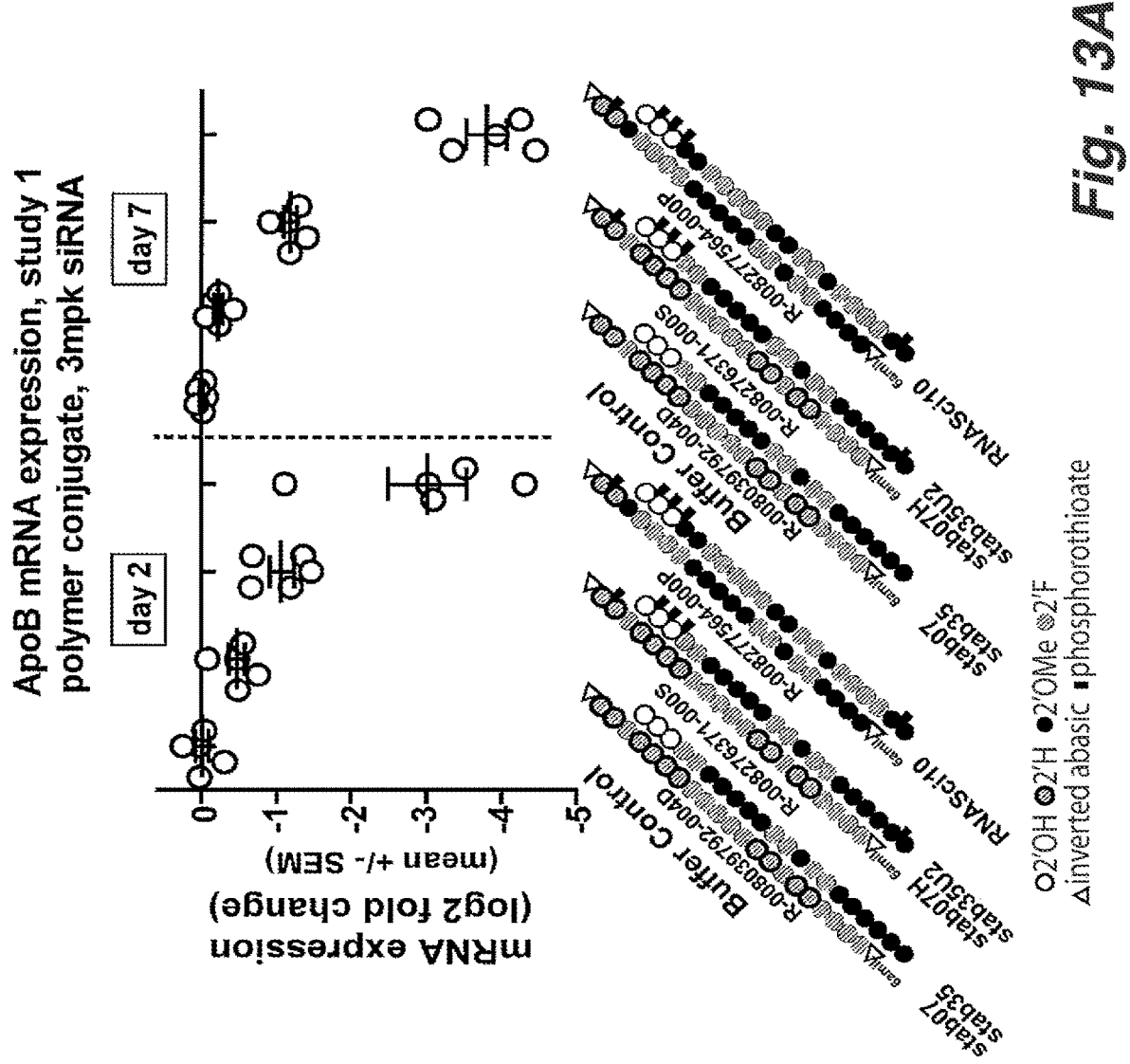
Figure 13B:
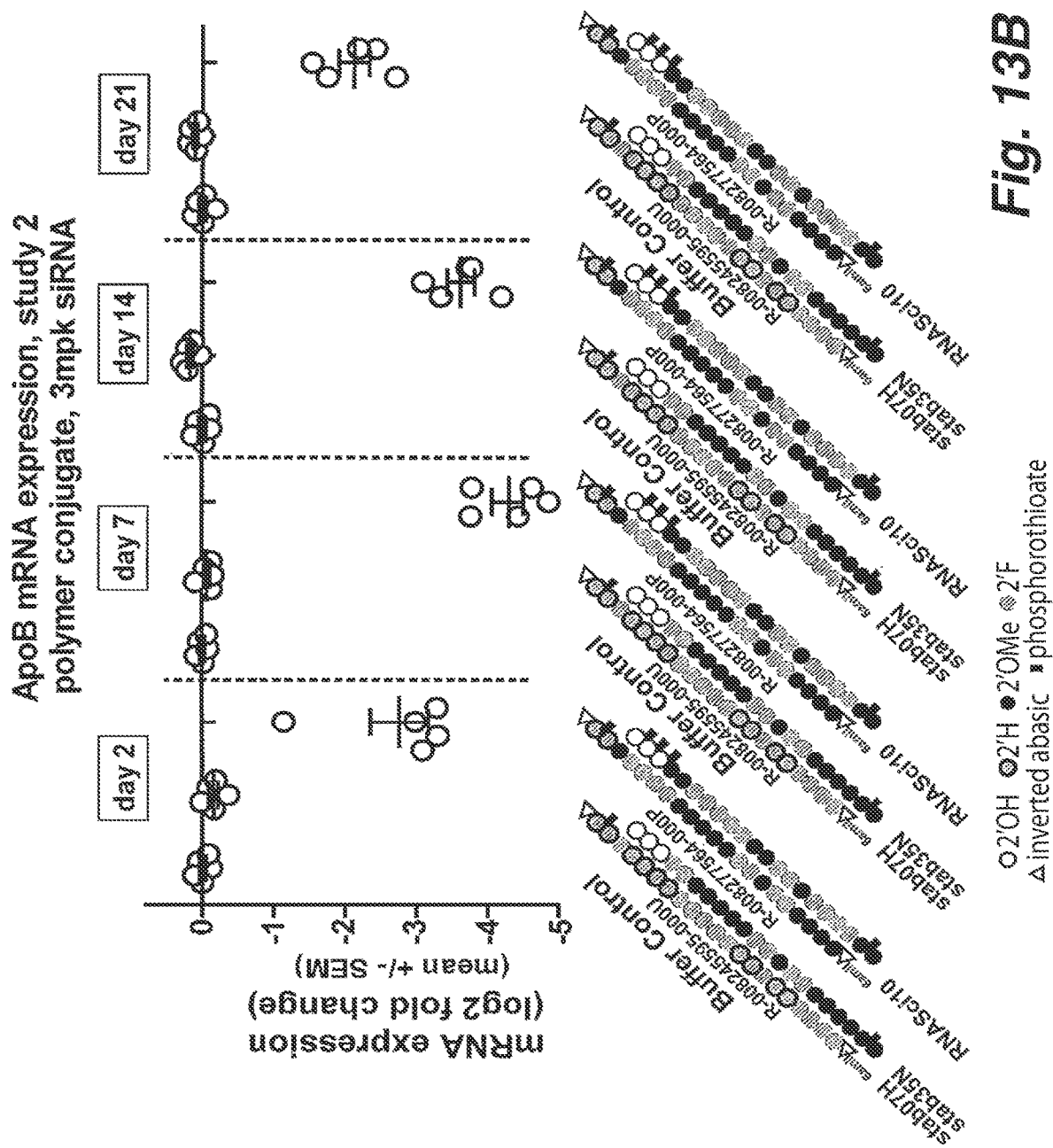

FIGS. 13A and 13B depict in vivo data for ApoB siRNA with the Sci10 modification motif. mRNA knockdown is shown as log 2 fold change in liver mRNA expression with negative values indicating a greater amount of siRNA knockdown. ApoB liver mRNA expression was measured by quantitative RT-PCR. siRNAs were delivered to mice using the polymer conjugate delivery vehicle. Knockdown is compared at day 2 and day 7 timepoints (FIG. 13A) and days 2, 7, 14, 21 (FIG. 13B). Relative to the 07/35 modification motifs, the Sci10 modification motif has greater initial knockdown and longer duration of activity.

Figure 14A:
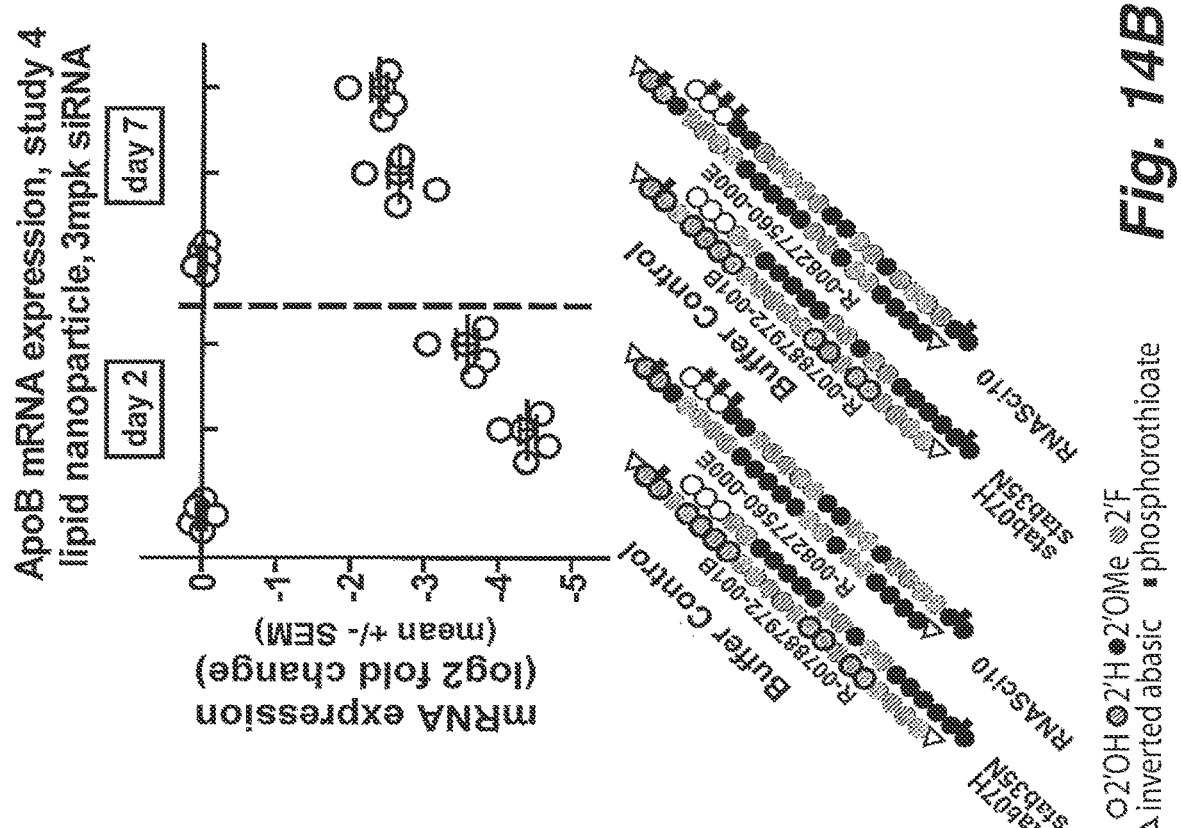
Figure 14B:
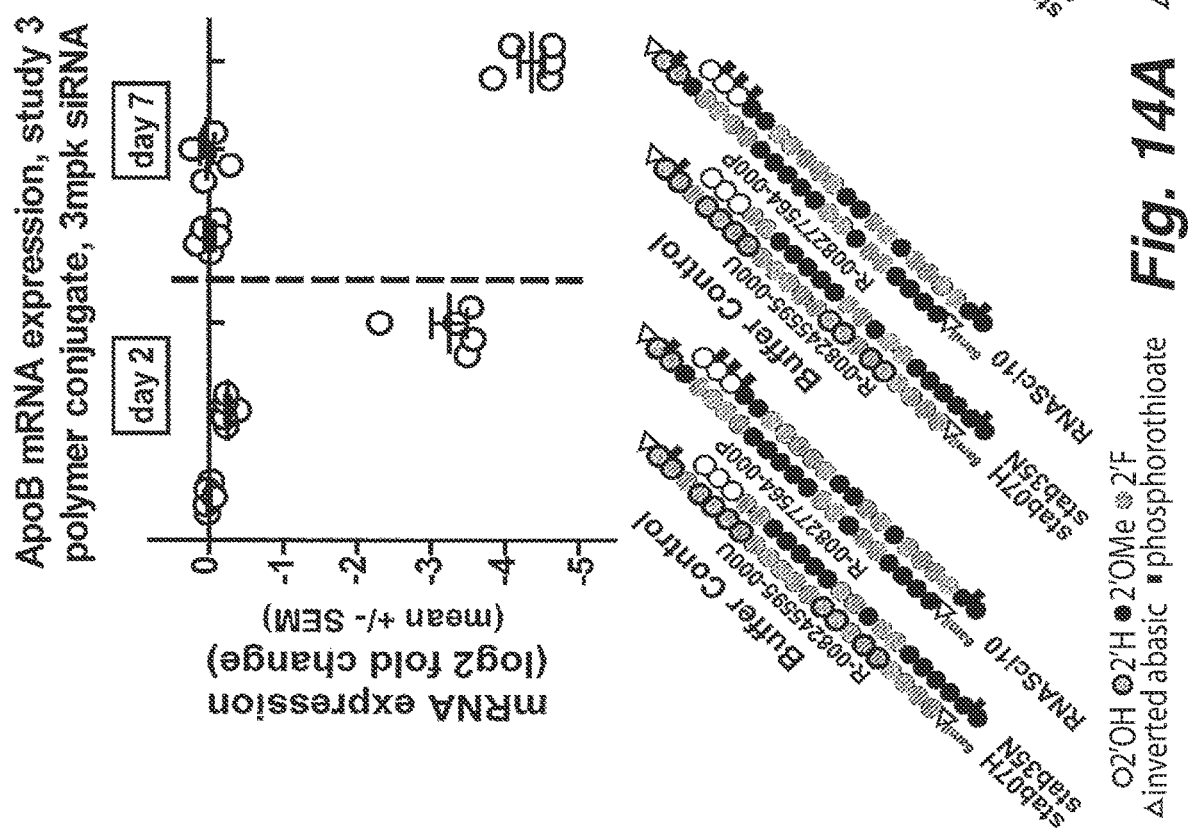

FIGS. 14A and 14B depict data demonstrating that the Sci10 modification motif is compatible with polymer conjugate (FIG. 14A) and lipid nanoparticle (FIG. 14B) delivery vehicles in vivo. ApoB mRNA expression was measured from mouse livers as discussed with respect to FIGS. 13A and 13B. The composition of the lipid nanoparticle shields the siRNA cargo from serum nucleases and therefore the 07H/35N modification motif is equivalently active to the Sci10 motif with this particular LNP delivery platform. Note that the LNP delivered siRNAs (FIG. 14B) differ slightly from the PC delivered siRNAs (FIG. 14A). The siRNAs in (FIG. 14B) do not contain the amino linker (6amiL) which is used to conjugate the siRNA to the PC delivery vehicle.

Figure 15:
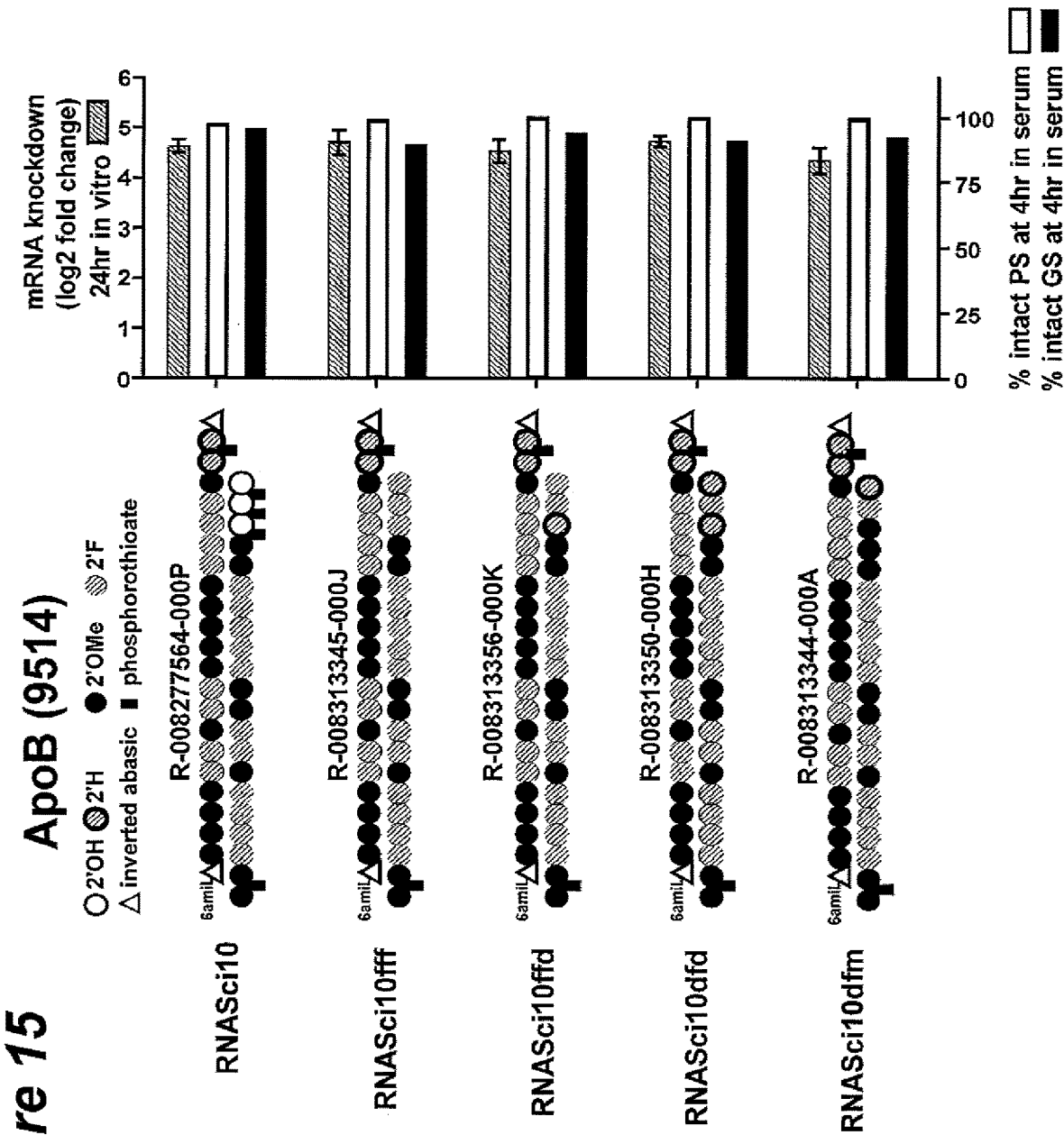

FIG. 15 depicts a comparison of the in vitro mRNA knockdown and serum stability for ApoB Sci10 and modified variants. These modified variants replace the three phosphorothioate linkages at the 5' of the guide strand with specific combinations of 2' ribose sugar modifications to positions 1-3 of the guide. The Sci10 modification motif and details of knockdown and stability measurements are described in FIG. 11. The variants to position 1-3 of the guide strand are: "Sci10fff" representing 2'F at positions 1-3; "Sci10ffd" representing 2'F at positions 1-2 and 2'H at position 3; "Sci10dfd" representing 2'H at position 1,2'F at position 2, and 2'H at position 3; "Sci10dfm" representing 2'H at position 1,2'F at position 2, and 2'OMe at position 3. The Sci10 variants have vitro mRNA knockdown and serum stability comparable to the Sci10 modification motif containing phosphorothioates at the 5' of the guide strand.

Figure 16:
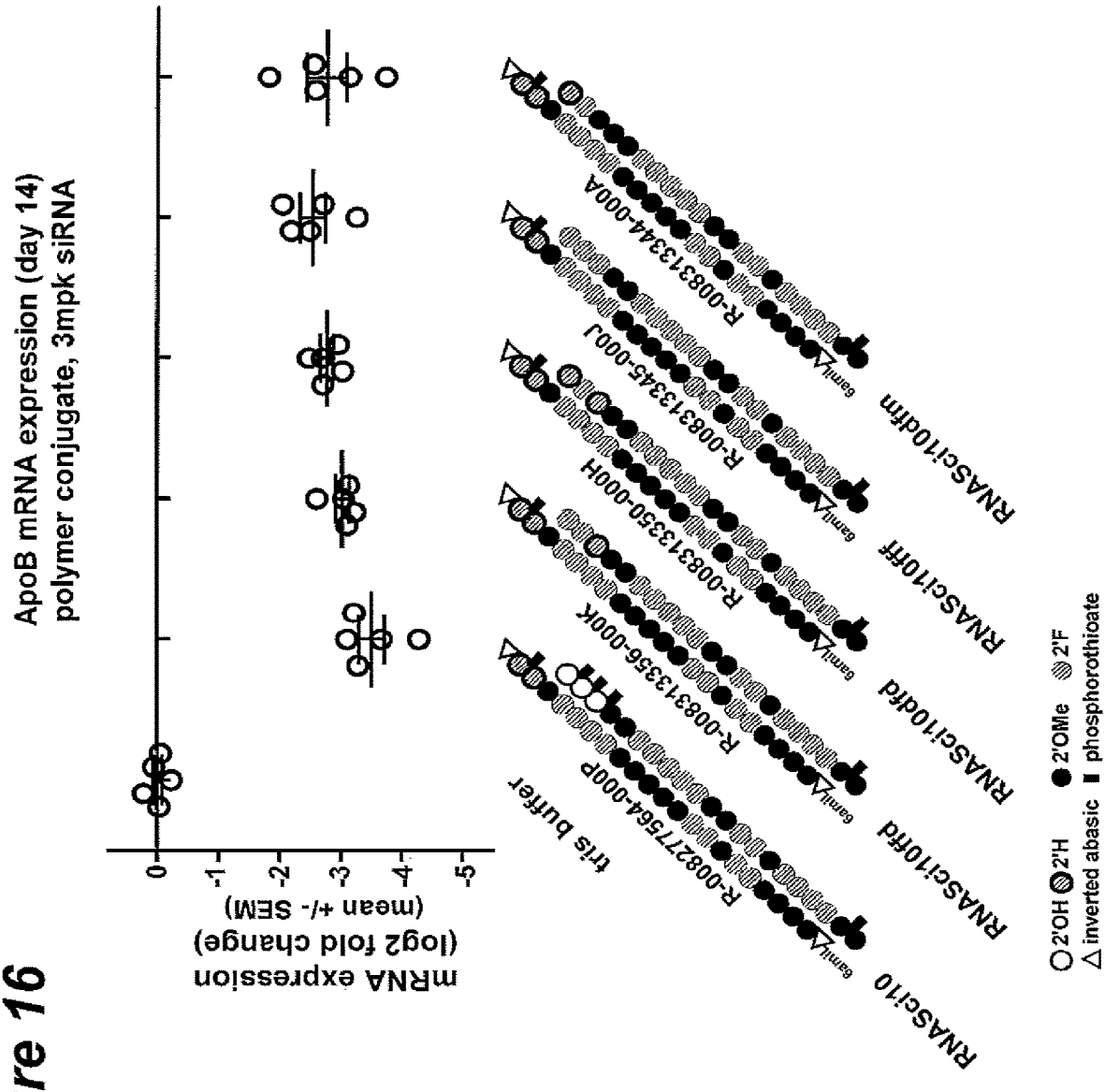

FIG. 16 depicts that 5'-guide strand modified variants of the Sci10 modification motif possess equivalent in vivo duration of mRNA knockdown relative to the Sci10 modification motif with phosphorothioate modifications at the 3 terminal 5'-guide strand positions. siRNAs were delivered with polymer conjugate and ApoB mRNA expression was measured from mouse livers as discussed in FIGS. 13A and 13B. FIG. 15 details the in vitro knockdown and stability for these siRNAs.

Figure 17:
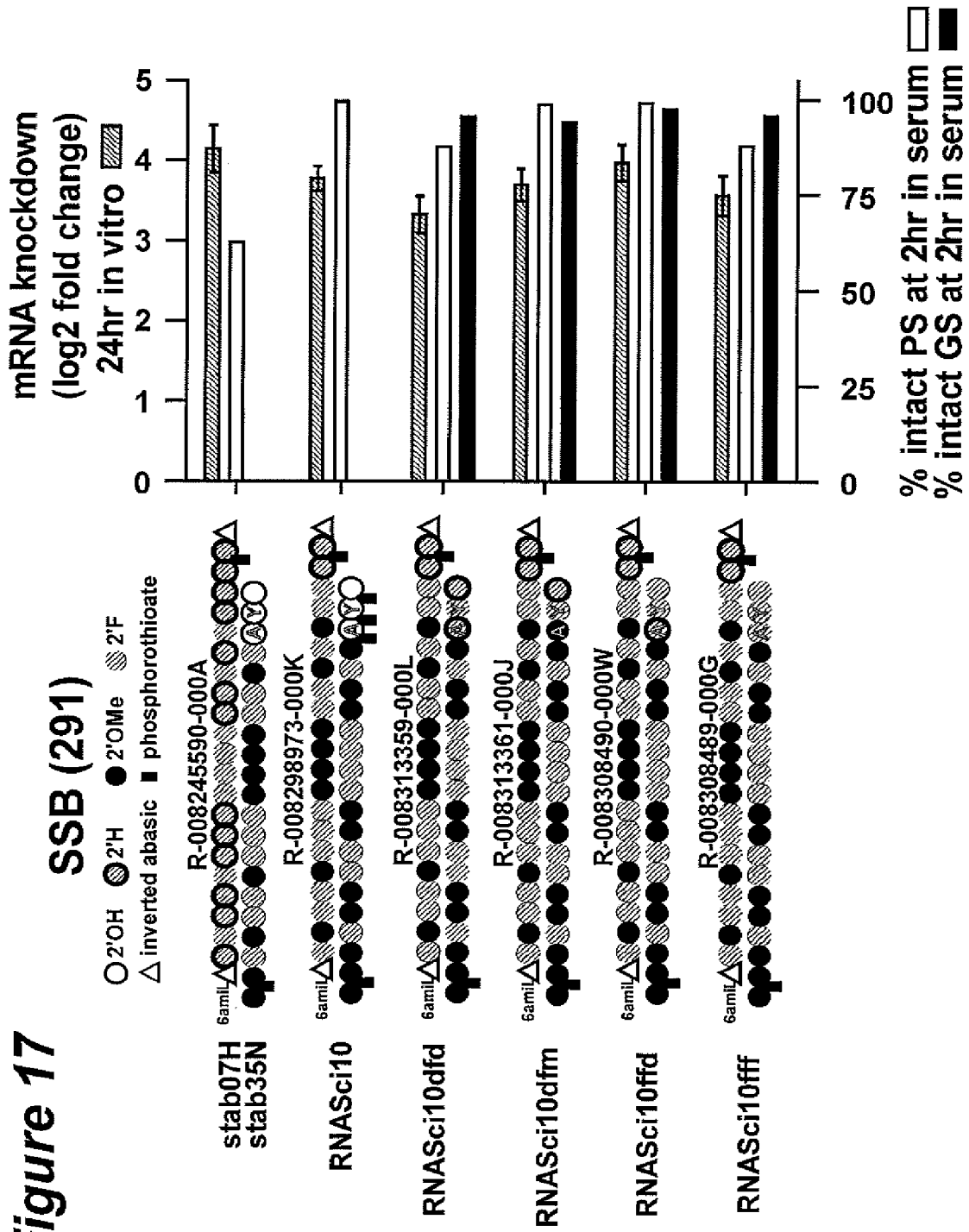

FIG. 17 depicts that the Sci10 modification motif can be applied to other sequences of interest, such as SSB (291), while retaining in vitro mRNA knockdown activity while significantly improving serum nuclease stability. The 07H/35N siRNA has moderate passenger strand stability and little observable guide strand stability. The Sci10 modification motif containing 5' guide strand phosphorothioate linkages improves passenger strand stability but has no affect on the guide strand. The "YA" at positions 2-3 of the siRNA guide strand indicate the presence of a pyrimidine-adenosine motif which is known to be highly susceptible to nuclease cleavage. Replacement of the 5' phosphorothioates with the variants described in FIG. 15 results in significantly improved guide strand stability while retaining mRNA activity. The 07/35 and Sci10 modification motifs and details of knockdown and stability measurements are described in FIG. 11.

Figure 18:
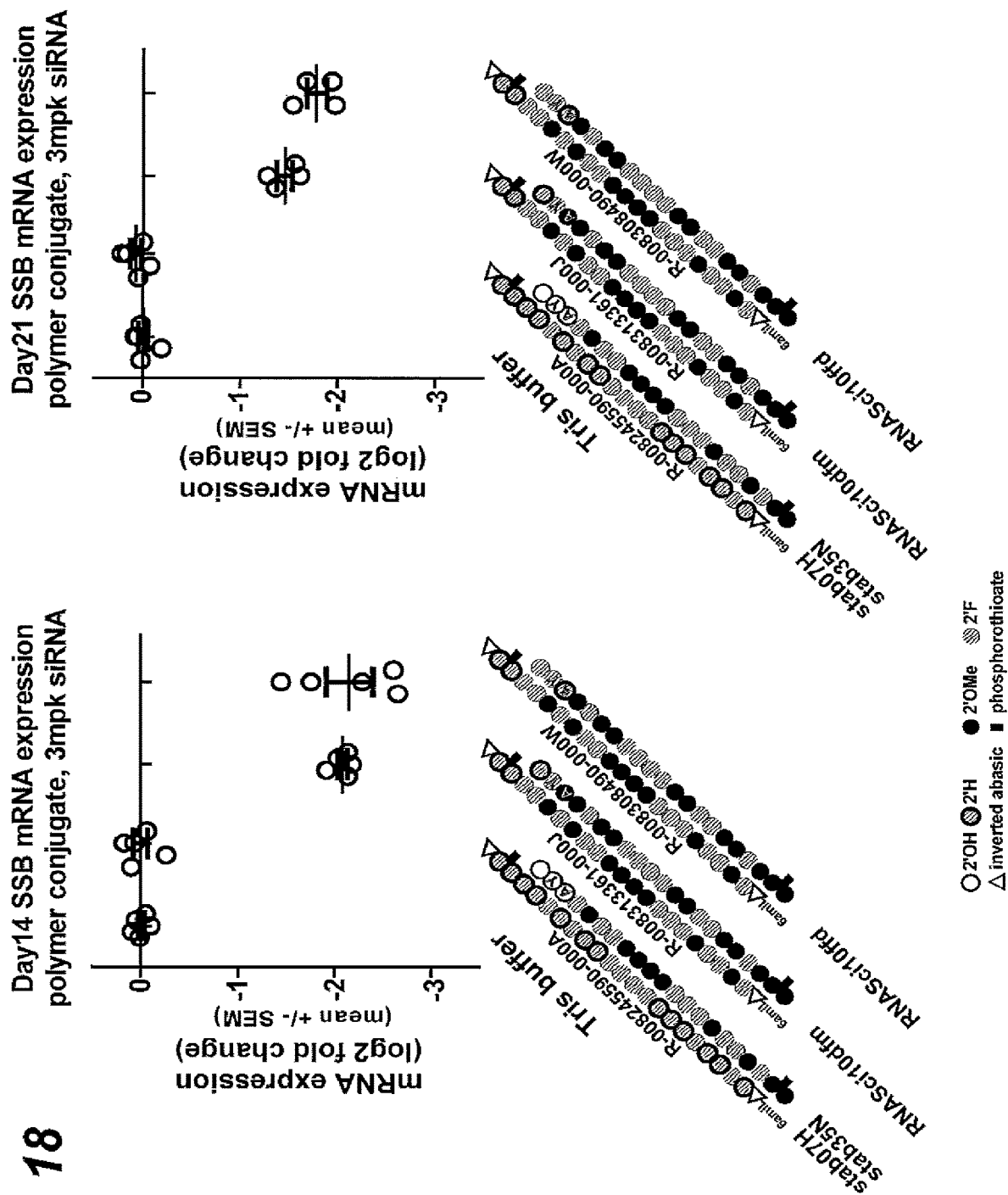

FIG. 18 depicts data in which SSB (291) siRNAs with the Sci10dfm and Sci10ffd motifs were compared against the 07H/35N motif in vivo for duration of mRNA knockdown. The Sci10 modification motifs exceed 07H/35N in initial knockdown and duration of the knockdown effect. siRNAs were delivered with polymer conjugate and SSB mRNA expression was measured from mouse livers using methods discussed in FIGS. 13A and 13B.

Figure 19A:
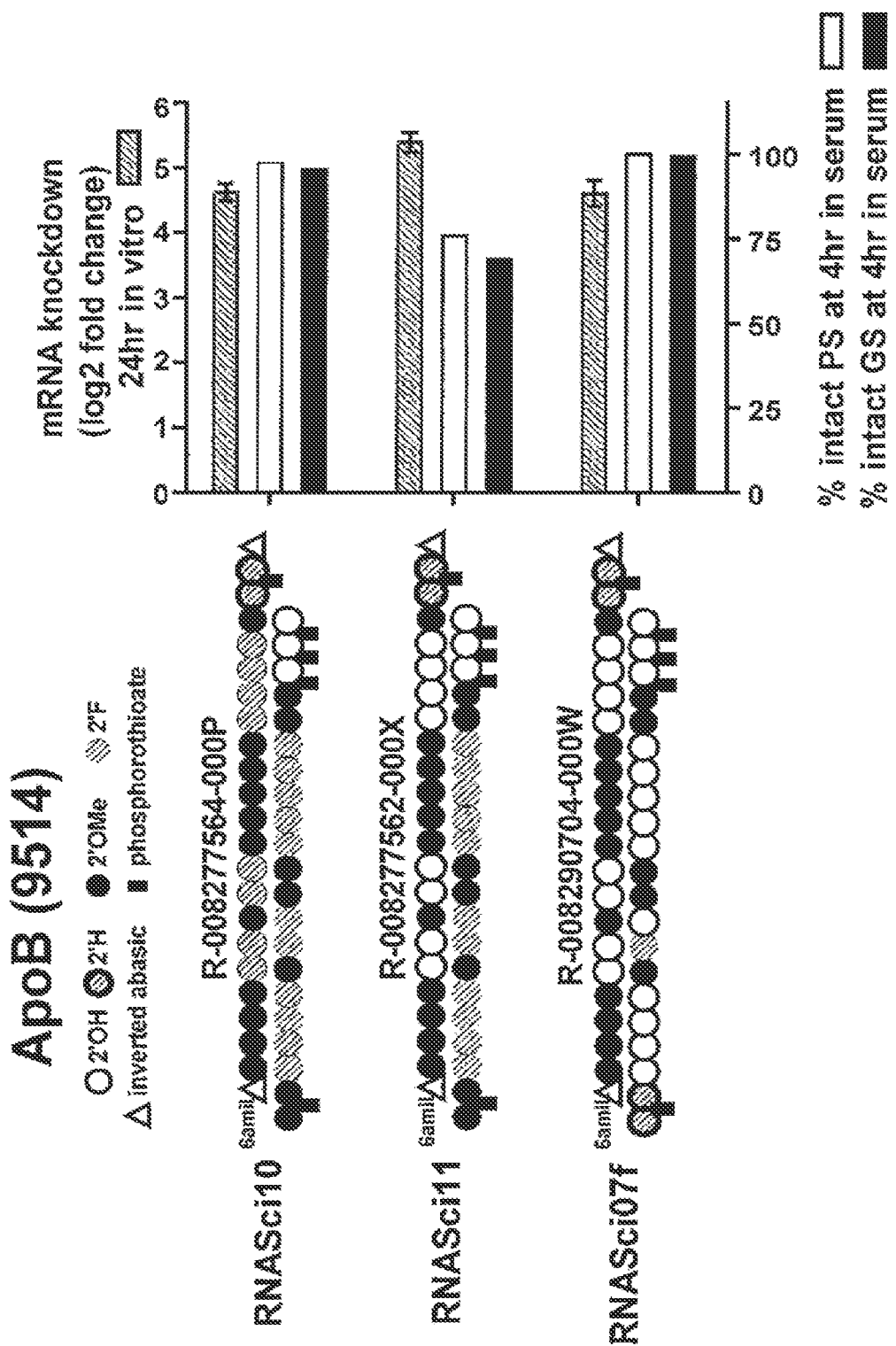
Figure 19B:
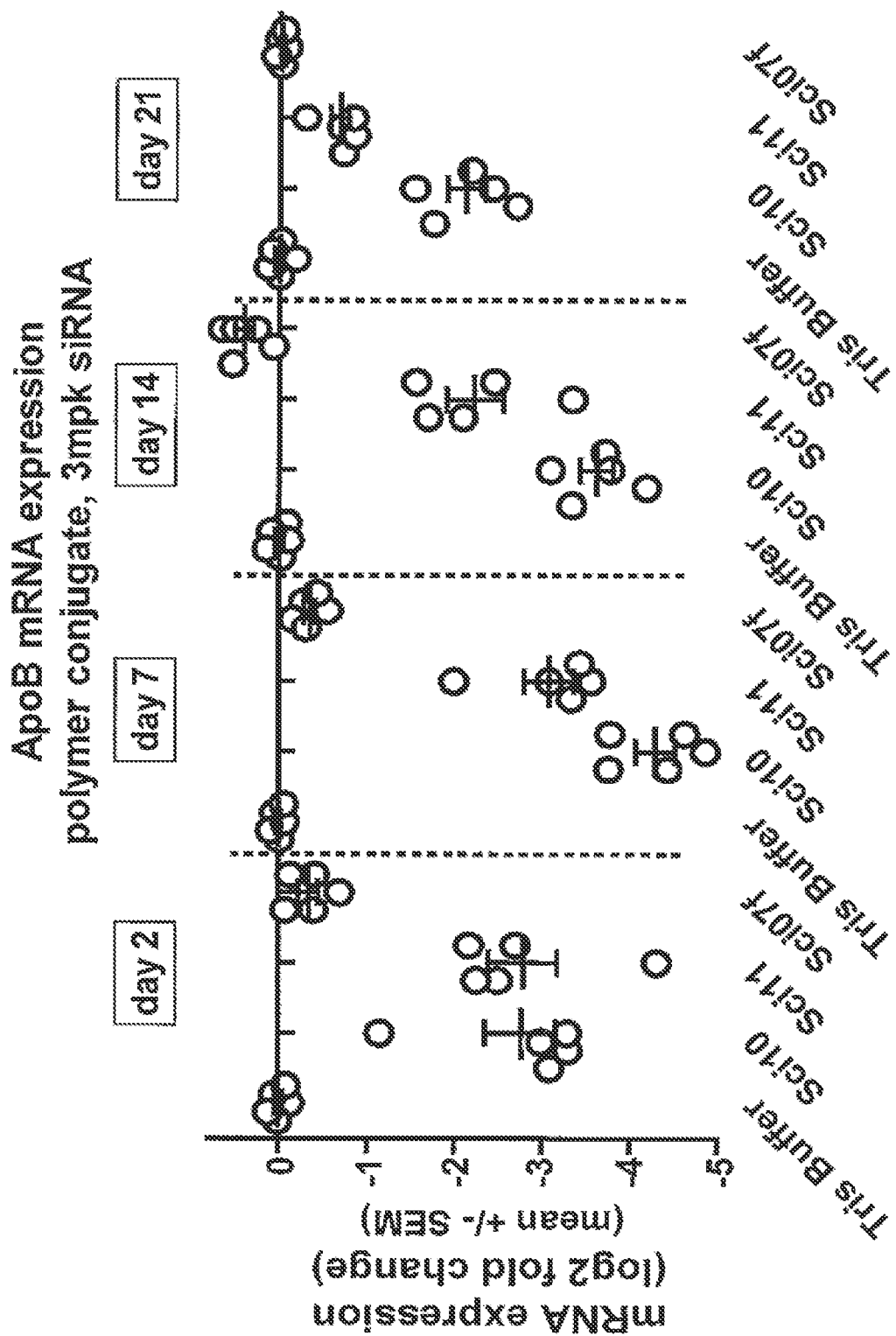

FIGS. 19A and 19B depict that 2'F content in the Sci10 modification motif confers improved in vivo duration of mRNA knockdown. (FIG. 19A) ApoB (9514) Sci10 modification motif is compared to Sci11 (2'F purines in passenger strand are changed to 2'OH) and Sci07f (2'F purines in both passenger and guide strand are changed to 2'OH). Overall in vitro knockdown and stability levels are similar among these siRNAs, though Sci11 has slightly reduced stability. Details of knockdown and stability measurements are discussed in FIG. 11. (FIG. 19B) Duration of in vivo knockdown is compared for Sci10, Sci11 and Sci07f. Sci11 has intermediate activity and less duration than Sci10 and Sci07f has no significant mRNA knockdown. This graded response appears to correlate with the amount of 2'F content present in the siRNA. siRNAs were delivered with polymer conjugate and ApoB mRNA expression was measured from mouse livers as discussed in FIGS. 13A and 13B. (FIG. 19C) Comparison of the in vivo liver metabolism of Sci10, Sci11, and Sci07f siRNAs at 48 hours. The FDA defines a major metabolite as "those formed at greater than 10 percent of parent drug systemic exposure at steady state". Therefore major metabolites are defined as >10% of parent strand at 48 hours and minor metabolites are defined as <10% of parent strand at 48 hours. Sci10 shows only minor metabolism sites while Sci11 and Sci07f have sites of major cleavage suggesting 2'F content improves intracellular stability.

Figure 20A:
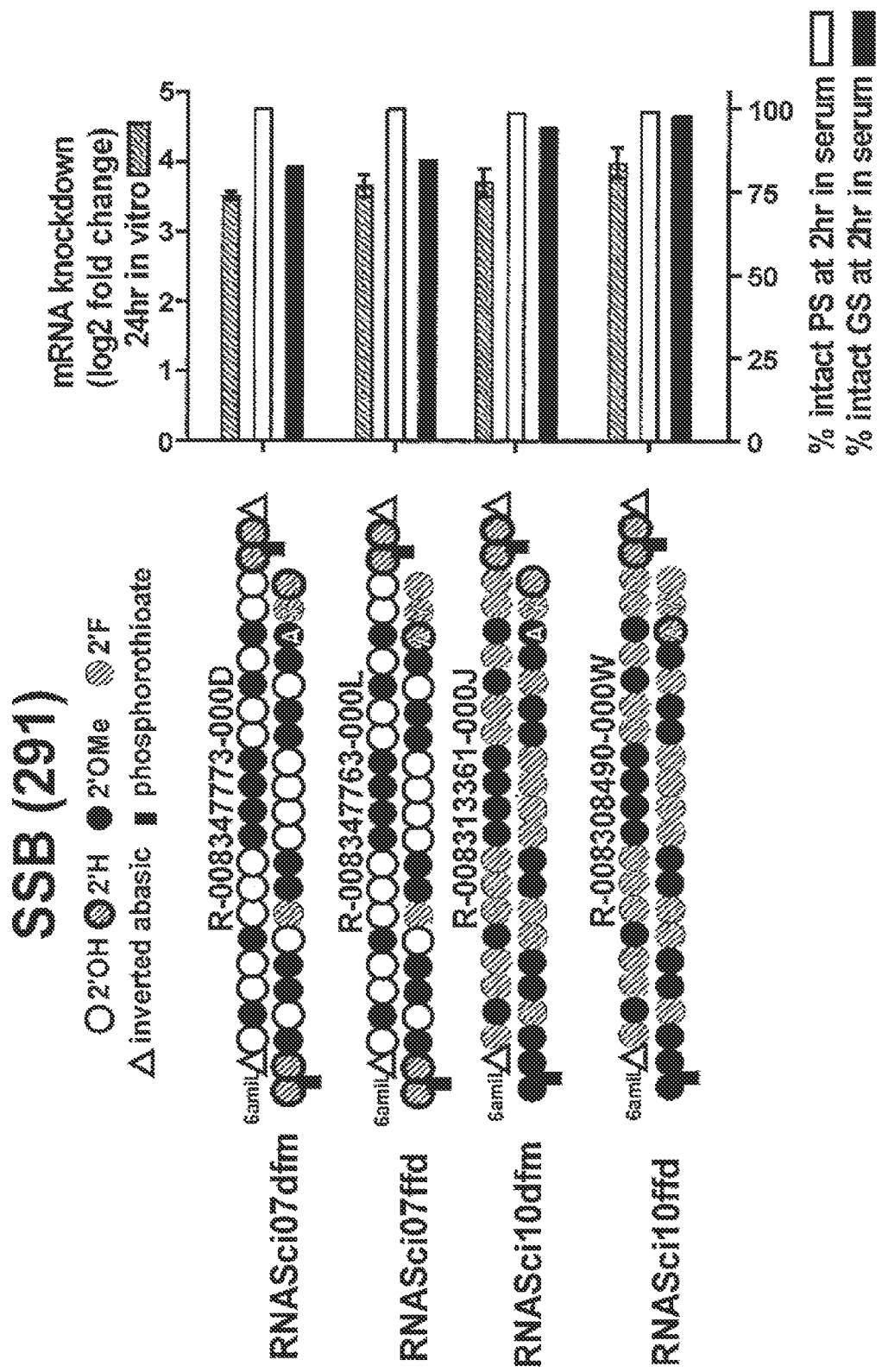
Figure 20B:
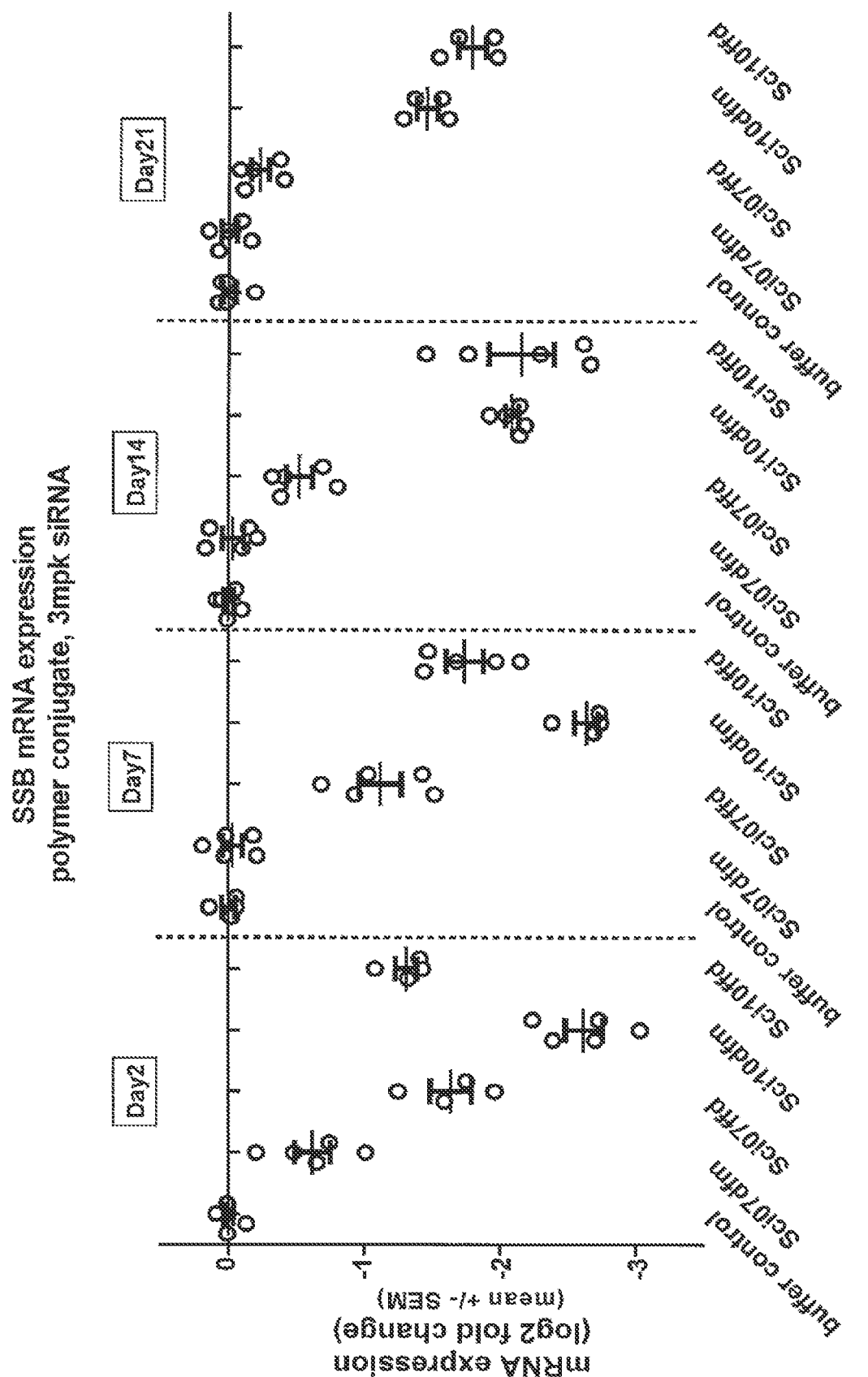

FIGS. 20A and 20B depict that 2'F content is also important for the in vivo duration of other siRNAs containing the Sci10 modification motif. (FIG. 20A) Comparison of variants of Sci10 (see FIG. 17) which have 2'F purine content and siRNAs which the 2'F purines are instead 2'OH (Sci07 variants). Details of knockdown and stability measurements are discussed in FIG. 11. (FIG. 20B) Sci10 modifications have significant duration of mRNA knockdown over 21 days while the Sci07 variants have significantly reduced duration. As seen for ApoB (FIG. 19B) this suggests that 2'F content can be important for duration of siRNA knockdown in vivo. siRNAs were delivered with polymer conjugate and SSB mRNA expression was measured from mouse livers using methods discussed in FIGS. 13A and 13B.

DETAILED DESCRIPTION OF THE INVENTION

A. Terms and Definitions

The following terminology and definitions apply as used in the present application.

As used in this specification and the appended claims, the singular forms "a," "an," and "the" include plural referents unless the content clearly dictates otherwise. Thus, for example, reference to "a cell" includes a combination of two or more cells, and the like.

Any concentration range, percentage range, ratio range or integer range is to be understood to include the value of any integer within the recited range, and when appropriate, fractions thereof (such as on tenth and one hundredth of an integer), unless otherwise indicated.

"About" or "approximately," as used herein, in reference to a number are generally taken to include numbers that fall within a range of 5% in either direction (greater than or less than) of the number unless otherwise stated or otherwise evident from the context (except where such number would exceed 100% of a possible value). Where ranges are stated, the endpoints are included within the range unless otherwise stated or otherwise evident from the context.

The term "abasic" as used herein refers to its meaning as is generally accepted in the art. The term generally refers to sugar moieties lacking a nucleobase or having a hydrogen atom (H) or other non-nucleobase chemical groups in place of a nucleobase at the 1' position of the sugar moiety, see for example Adamic et al., U.S. Pat. No. 5,998,203. In one embodiment, an abasic moiety of the invention is a ribose, deoxyribose, or dideoxyribose sugar.

The term "acyclic nucleotide" as used herein refers to its meaning as is generally accepted in the art. The term generally refers to any nucleotide having an acyclic ribose sugar, for example where any of the ribose carbon/carbon or carbon/oxygen bonds are independently or in combination absent from the nucleotide.

The term "alkyl" as used herein refers to its meaning as is generally accepted in the art. The term generally refers to a saturated or unsaturated hydrocarbons, including straight-chain, branched-chain, alkenyl, alkynyl groups and cyclic groups, but excludes aromatic groups. Notwithstanding the foregoing, alkyl also refers to non-aromatic heterocyclic groups. Preferably, the alkyl group has 1 to 12 carbons. More preferably, it is a lower alkyl of from 1 to 7 carbons, more preferably 1 to 4 carbons. The alkyl group can be substituted or unsubstituted. When substituted, the substituted group(s) is preferably, hydroxyl, halogen, cyano, C1-C4 alkoxy, =O, =S, $NO_2$, SH, $NH_2$, or $NR_1R_2$, where $R_1$ and $R_2$ independently are H or C1-C4 alkyl.

The phrase "agents that interfere with cell cycle checkpoints" refers to compounds that inhibit protein kinases that transduce cell cycle checkpoint signals, thereby sensitizing the cancer cell to DNA damaging agents.

The phrase "agents that interfere with receptor tyrosine kinases (RTKs)" refers to compounds that inhibit RTKs and therefore inhibit mechanisms involved in oncogenesis and tumor progression.

The phrase "androgen receptor modulators" refers to compounds that interfere or inhibit the binding of androgens to the receptor, regardless of mechanism.

The phrase "angiogenesis inhibitors" refers to compounds that inhibit the formation of new blood vessels, regardless of mechanism.

The term "aryl" as used herein refers to its meaning as is generally accepted in the art. The term generally refers to an aromatic group that has at least one ring having a conjugated pi electron system and includes carbocyclic aryl, heterocyclic aryl and biaryl groups, all of which can be optionally substituted. The preferred substituent(s) of aryl groups are halogen, trihalomethyl, hydroxyl, SH, OH, cyano, C1-C4 alkoxy, C1-C4 alkyl, C2-C4 alkenyl, C2-C4 alkynyl, $NH_2$, and $NR_1R_2$ groups, where $R_1$ and $R_2$ independently are H or C1-C4 alkyl.

The term "alkylaryl" as used herein refers to its meaning as is generally accepted in the art. The term generally refers to an alkyl group (as described above) covalently joined to an aryl group (as described above). Carbocyclic aryl groups are groups wherein the ring atoms on the aromatic ring are all carbon atoms. The carbon atoms are optionally substituted. Heterocyclic aryl groups are groups having from 1 to 3 heteroatoms as ring atoms in the aromatic ring and the remainder of the ring atoms are carbon atoms. Suitable heteroatoms include oxygen, sulfur, and nitrogen, and examples of heterocyclic aryl groups having such heteroatoms include furanyl, thienyl, pyridyl, pyrrolyl, N-lower alkyl pyrrolo, pyrimidyl, pyrazinyl, imidazolyl and the like, all optionally substituted. Preferably, the alkyl group is a C1-C4 alkyl group.

The term "amide" as used herein refers to its meaning as is generally accepted in the art. The term generally refers to an C(O)—NH—R, where R is either alkyl, aryl, alkylaryl or hydrogen.

The phrase "antisense region" as used herein refers to its meaning as is generally accepted in the art. With reference to exemplary nucleic acid molecules of the invention, the term refers to a nucleotide sequence of an siNA molecule having complementarity to a target nucleic acid sequence. In addition, the antisense region of an siNA molecule can optionally comprise a nucleic acid sequence having complementarity to a sense region of the siNA molecule. In one embodiment, the antisense region of the siNA molecule is referred to as the antisense strand or guide strand.

The phrase "asymmetric hairpin" refers to a linear siNA molecule comprising an antisense region, a loop portion that can comprise nucleotides or non-nucleotides, and a sense region that comprises fewer nucleotides than the antisense region to the extent that the sense region has enough complementary nucleotides to base pair with the antisense region and form a duplex with loop. For example, an asymmetric hairpin siNA molecule of the invention can comprise an antisense region having length sufficient to mediate RNAi in a cell or in vitro system (e.g. about 15 to about 30, or about 15, 16, 17, 18, 19, 20, 21, 22, 23, 24, 25, 26, 27, 28, 29, or 30 nucleotides) and a loop region comprising about 4 to about 12 (e.g., about 4, 5, 6, 7, 8, 9, 10, 11, or 12) nucleotides, and a sense region having about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides that are complementary to the antisense region. The asymmetric hairpin siNA molecule can also comprise a 5'-terminal phosphate group that can be chemically modified. The loop portion of the asymmetric hairpin siNA molecule can comprise nucleotides, non-nucleotides, linker molecules, or conjugate molecules as described herein.

The term "biodegradable" as used herein refers to its meaning as is generally accepted in the art. The term generally refers to degradation in a biological system, for example, enzymatic degradation or chemical degradation.

The term "biodegradable linker" as used herein refers to its meaning as is generally accepted in the art. With reference to exemplary nucleic acid molecules of the invention, the term refers to a linker molecule that is designed to connect one molecule to another molecule, and which is susceptible to degradation in a biological system. The linker can be a nucleic acid or non-nucleic acid based linker. For example, a biodegradable linker can be used to attach a ligand or biologically active molecule to an siNA molecule of the invention. Alternately, a biodegradable linker can be used to connect the sense and antisense strands of an siNA molecule of the invention. The biodegradable linker is designed such that its stability can be modulated for a particular purpose, such as delivery to a particular tissue or cell type. The stability of a nucleic acid-based biodegradable linker molecule can be modulated by using various chemistries, for example combinations of ribonucleotides, deoxyribonucleotides, and chemically modified nucleotides, such as 2'-O-methyl, 2'-fluoro, 2'-amino, 2'-O-amino, 2'-C-allyl, 2'-O-allyl, and other 2'-modified or base modified nucleotides. The biodegradable nucleic acid linker molecule can be a dimer, trimer, tetramer or longer nucleic acid molecule, for example, an oligonucleotide of about 2, 3, 4, 5, 6, 7, 8, 9, 10, 11, 12, 13, 14, 15, 16, 17, 18, 19, or 20 nucleotides in length, or can comprise a single nucleotide with a phosphorus-based linkage, for example, a phosphoramidate or phosphodiester linkage. The biodegradable nucleic acid linker molecule can also comprise nucleic acid backbone, nucleic acid sugar, or nucleic acid base modifications.

The phrase "biologically active molecule" as used herein refers to its meaning as is generally accepted in the art. With reference to exemplary nucleic acid molecules of the invention, the term refers to compounds or molecules that are capable of eliciting or modifying a biological response in a system and/or are capable of modulating the pharmacokinetics and/or pharmacodynamics of other biologically active molecules. Examples of biologically active molecules, include siNA molecules alone or in combination with other molecules including, but not limited to therapeutically active molecules such as antibodies, cholesterol, hormones, antivirals, peptides, proteins, chemotherapeutics, small molecules, vitamins, co-factors, nucleosides, nucleotides, oligonucleotides, enzymatic nucleic acids, antisense nucleic acids, triplex forming oligonucleotides, polyamines, polyamides, polyethylene glycol, other polyethers, 2-5A chimeras, siNA, dsRNA, allozymes, aptamers, decoys and analogs thereof.

The phrase "biological system" as used herein refers to its meaning as is generally accepted in the art. The term generally refers to material, in a purified or unpurified form, from biological sources including, but not limited to, human or animal, wherein the system comprises the components required for RNAi activity. Thus, the phrase includes, for example, a cell, tissue, subject, or organism, or extract thereof. The term also includes reconstituted material from a biological source.

The phrase "blunt end" as used herein refers to its meaning as is generally accepted in the art. With reference to exemplary nucleic acid molecules of the invention, the term refers to termini of a double-stranded siNA molecule having no overhanging nucleotides. For example, the two strands of a double-stranded siNA molecule having blunt ends align with each other with matched base-pairs without overhanging nucleotides at the termini. A siNA duplex molecule of the invention can comprise blunt ends at one or both termini of the duplex, such as termini located at the 5'-end of the antisense strand, the 5'-end of the sense strand, or both termini of the duplex.

The term "cap" also referred to herein as "terminal cap," as used herein refers to its meaning as is generally accepted in the art. With reference to exemplary nucleic acid molecules of the invention, the term refers to a moiety, which can be a chemically modified nucleotide or non-nucleotide that can be incorporated at one or more termini of one or more nucleic acid molecules of the invention. These terminal modifications protect the nucleic acid molecule from exonuclease degradation, and can help in delivery and/or localization within a cell. The cap can be present at the 5'-terminus (5'-cap) or at the 3'-terminal (3'-cap) or can be present on both termini of any nucleic acid molecule of the invention. A cap can be present at the 5'-end, 3-end and/or 5' and 3'-ends of the sense strand of a nucleic acid molecule of the invention. Additionally, a cap can optionally be present at the 3'-end of the antisense strand of a nucleic acid molecule of the invention. In non-limiting examples, the 5'-cap includes, but is not limited to a polymer; a ligand; locked nucleic acid (LNA); glyceryl; an abasic ribose residue (moiety); inverted deoxy abasic residue (moiety); an inverted nucleotide; 4',5'-methylene nucleotide; 1-(beta-D-erythrofuranosyl) nucleotide, 4'-thio nucleotide; carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl nucleotide; 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety. Non-limiting examples of the 3'-cap include, but are not limited to, a polymer; a ligand; locked nucleic acid (LNA); glyceryl; an abasic ribose residue (moiety); inverted deoxy abasic residue (moiety); an inverted nucleotide; 4',5'-methylene nucleotide; 1-(beta-D-erythrofuranosyl) nucleotide; 4'-thio nucleotide; carbocyclic nucleotide; 5'-amino-alkyl phosphate; 1,3-diamino-2-propyl phosphate; 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moiety; 5'-5'-inverted abasic moiety; 5'-phosphoramidate; 5'-phosphorothioate; 1,4-butanediol phosphate; 5'-amino; bridging and/or non-bridging 5'-phosphoramidate; phosphorothioate and/or phosphorodithioate; bridging or non bridging methylphosphonate; and 5'-mercapto moieties (for more details see Beaucage and Iyer, 1993, *Tetrahedron* 49, 1925; incorporated by reference herein). In certain embodiments, a siNA molecule of the invention having Forumla (A) can comprise one or more terminal cap molecules as described above (designated as B) that comprises or includes a covalent attachment to a polymer or ligand via a linker molecule as described herein or as is otherwise known in the art. Non-limiting examples of such linkers are provided in the examples herein. FIGS. 6 and 10 show some non-limiting examples of various caps.

The term "cell" as used herein refers to its meaning as is generally accepted in the art. With reference to exemplary nucleic acid molecules of the invention, the term is used in its usual biological sense, and does not refer to an entire multicellular organism, e.g., specifically does not refer to a human being. The cell can be present in an organism, e.g., birds, plants and mammals, such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell.

The phrase "chemical modification" as used herein refers to its meaning as is generally accepted in the art. With reference to exemplary nucleic acid molecules of the invention, the term refers to any modification of the chemical structure of the nucleotides that differs from nucleotides of native siRNA or RNA in general. The term "chemical modification" encompasses the addition, substitution, or modification of native siRNA or RNA at the sugar, base, or internucleotide linkage, as described herein or as is otherwise known in the art. In certain embodiments, the term "chemical modification" can refer to certain forms of RNA that are naturally occurring in certain biological systems, for example 2'-O-methyl modifications or inosine modifications.

The term "complementarity" or "complementary" as used herein refers to its meaning as is generally accepted in the art. With reference to exemplary nucleic acid molecules of the invention, the terms generally refer to the formation or existence of hydrogen bond(s) between one nucleic acid sequence and another nucleic acid sequence by either traditional Watson-Crick or other non-traditional types of bonding as described herein. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, *CSH Symp. Quant. Biol.* LII pp. 123-133; Frier et al., 1986, *Proc. Nat. Acad. Sci.* USA 83:9373-9377; Turner et al., 1987, *J. Am. Chem. Soc.* 109:3783-3785). Perfect complementary means that all the contiguous residues of a nucleic acid sequence will hydrogen bond with the same number of contiguous residues in a second nucleic acid sequence. Partial complementarity can include various mismatches or non-based paired nucleotides (e.g., 1, 2, 3, 4, 5, 6, 7, 8, 9, 10 or more mismatches, non-nucleotide linkers, or non-based paired nucleotides) within the nucleic acid molecule, which can result in bulges, loops, or overhangs that result between the sense strand or sense region and the antisense strand or antisense region of the nucleic acid molecule or between the antisense strand or antisense region of the nucleic acid molecule and a corresponding target nucleic acid molecule. Such partial complementarity can be represented by a % complementarity that is determined by the number of non-base paired nucleotides, i.e., about 50%, 60%, 70%, 80%, 90% etc. depending on the total number of nucleotides involved. Such partial complementarity is permitted to the extent that the nucleic acid molecule (e.g., siNA) maintains its function, for example the ability to mediate sequence specific RNAi.

The terms "composition" or "formulation" as used herein refer to their generally accepted meaning in the art. These terms generally refer to a composition or formulation, such as in a pharmaceutically acceptable carrier or diluent, in a form suitable for administration, e.g., systemic or local administration, into a cell or subject, including, for example, a human. Suitable forms, in part, depend upon the use or the route of entry, for example oral, transdermal, inhalation, or by injection. Such forms should not prevent the composition or formulation from reaching a target cell (i.e., a cell to which the negatively charged nucleic acid is desirable for delivery). For example, compositions injected into the blood stream should be soluble. Other factors are known in the art, and include considerations such as toxicity and forms that prevent the composition or formulation from exerting its effect. As used herein, pharmaceutical formulations include formulations for human and veterinary use. Non-limiting examples of agents suitable for formulation with the nucleic acid molecules of the instant invention include: Lipid Nanoparticles (see for example Semple et al., 2010, *Nat Biotechnol.*, February; 28(2):172-6.); P-glycoprotein inhibitors (such as Pluronic P85); biodegradable polymers, such as poly (DL-lactide-coglycolide) microspheres for sustained release delivery (Emerich, D F et al, 1999, *Cell Transplant*, 8, 47-58); and loaded nanoparticles, such as those made of polybutylcyanoacrylate. Other non-limiting examples of delivery strategies for the nucleic acid molecules of the instant invention include material described in Boado et al., 1998, *J. Pharm. Sci.*, 87, 1308-1315; Tyler et al., 1999 *FEBS Lett.*, 421, 280-284; Pardridge et al., 1995, *PNAS USA.*, 92, 5592-5596; Boado, 1995, *Adv. Drug Delivery Rev.*, 15, 73-107; Aldrian-Herrada et al., 1998, *Nucleic Acids Res.*, 26, 4910-4916; and Tyler et al., 1999, PNAS USA., 96, 7053-7058. A "pharmaceutically acceptable composition" or "pharmaceutically acceptable formulation" can refer to a composition or formulation that allows for the effective distribution of the nucleic acid molecules of the instant invention to the physical location most suitable for their desired activity.

The phrase "cytotoxic/cytostatic agents" refer to compounds that cause cell death or inhibit cell proliferation primarily by interfering directly with the cell's functioning or inhibit or interfere with cell mytosis, including alkylating agents, tumor necrosis factors, intercalators, hypoxia activatable compounds, microtubule inhibitors/microtubule-stabilizing agents, inhibitors of mitotic kinesins, inhibitors of histone deacetylase, inhibitors of kinases involved in mitotic progression, antimetabolites; biological response modifiers; hormonal/anti-hormonal therapeutic agents, hematopoietic growth factors, monoclonal antibody targeted therapeutic agents, topoisomerase inhibitors, proteasome inhibitors and ubiquitin ligase inhibitors.

The phrase "estrogen receptor modulators" refers to compounds that interfere with or inhibit the binding of estrogen to the receptor, regardless of mechanism.

The term "gene" or "target gene" as used herein refers to their meaning as is generally accepted in the art. The terms generally refer a nucleic acid (e.g., DNA or RNA) sequence that comprises partial length or entire length coding sequences necessary for the production of a polypeptide. The target gene can also include the UTR or non-coding region of the nucleic acid sequence. A gene or target gene can also encode a functional RNA (fRNA) or non-coding RNA (ncRNA), such as small temporal RNA (stRNA), micro RNA (miRNA), small nuclear RNA (snRNA), short interfering RNA (siRNA), small nucleolar RNA (snRNA), ribosomal RNA (rRNA), transfer RNA (tRNA) and precursor RNAs thereof. Such non-coding RNAs can serve as target nucleic acid molecules for siNA mediated RNA interference in modulating the activity of fRNA or ncRNA involved in functional or regulatory cellular processes. Aberrant fRNA or ncRNA activity leading to disease can therefore be modulated by siNA molecules of the invention. siNA molecules targeting fRNA and ncRNA can also be used to manipulate or alter the genotype or phenotype of a subject, organism or cell, by intervening in cellular processes such as genetic imprinting, transcription, translation, or nucleic acid processing (e.g., transamination, methylation etc.). The target gene can be a gene derived from a cell, an endogenous gene, a transgene, or exogenous genes such as genes of a pathogen, for example a virus, which is present in the cell after infection thereof. The cell containing the target gene can be derived from or contained in any organism, for example a plant, animal, protozoan, virus, bacterium, or fungus. Non-limiting examples of plants include monocots, dicots, or gymnosperms. Non-limiting examples of animals include vertebrates or invertebrates. Non-limiting examples of fungi include molds or yeasts. For a review, see for example Snyder and Gerstein, 2003, Science, 300, 258-260. In certain embodiments, gene targets contemplated herein are also referred to herein generally as "target" sequences (including the target sequences listed by GenBank Accession numbers in U.S. Ser. No. 60/363,124, incorporated by reference herein).

The phrase "HMG-COA reductase inhibitors" refers to inhibitors of 3-hydroxy-3-methylglutaryl-CoA reductase. The term HMG-COA reductase inhibitor as used herein includes all pharmaceutically acceptable lactone and open-acid forms (i.e., where the lactone ring is opened to form the free acid) as well as salt and ester forms of compounds that have HMG-COA reductase inhibitory activity, and therefore the use of such salts, esters, open-acid and lactone forms is included within the scope of this invention.

The phrase "highly conserved sequence region" refers to a nucleotide sequence of one or more regions in a target gene that does not vary significantly from one generation to the other or from one biological system to the other.

The phrase "homologous sequence" as used herein refers to its meaning as is generally accepted in the art. The term generally refers a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes. A homologous sequence can be a nucleotide sequence that is shared by two or more non-coding polynucleotides, such as noncoding DNA or RNA, regulatory sequences, introns, and sites of transcriptional control or regulation. Homologous sequences can also include sequence regions shared by more than one polynucleotide sequence. The term "perfect homology" (or "perfectly homologous") as used herein refers to complete (100%) homology or "identity" between a reference sequence and a subject nucleic acid sequence. Homology does not need to be perfect identity (100%), however, as partially homologous sequences are also contemplated by and within the scope of the instant invention (e.g., at least 95%, 94%, 93%, 92%, 91%, 90%, 89%, 88%, 87%, 86%, 85%, 84%, 83%, 82%, 81%, 80% etc.). Percent homology is the number of matching nucleotides between two sequences divided by the total length being compared, multiplied by 100.

The phrase "improved RNAi activity" refers to an increase in RNAi activity measured in vitro and/or in vivo, where the RNAi activity is a reflection of both the ability of the siNA to mediate RNAi and the stability of the siNAs of the invention. In this invention, the product of these activities can be increased in vitro and/or in vivo compared to an all RNA siNA or an siNA containing a plurality of ribonucleotides. In some cases, the activity or stability of the siNA molecule can be decreased (i.e., less than ten-fold), but the overall activity of the siNA molecule is enhanced in vitro and/or in vivo.

The term "including" (and any form thereof, such as "includes" and "include"), "comprising" (and any form thereof, such as "has" or "have") or "containing" (and any form thereof such as "contains" or "contain") are inclusive and open-ended and do not exclude additional, unrecited elements or method steps.

The terms "inhibit," "down-regulate," or "reduce" as used herein refers to its meaning as is generally accepted in the art. With reference to exemplary nucleic acid molecules of the invention, the term generally refers the reduction in the expression of the gene, or level of RNA molecules or equivalent RNA molecules encoding one or more proteins or protein subunits, or activity of one or more proteins or protein subunits, below that observed in the absence of the nucleic acid molecules (e.g., siNA) of the invention. Down-regulation can also be associated with post-transcriptional silencing, such as, RNAi mediated cleavage or by alteration in DNA methylation patterns or DNA chromatin structure. Inhibition, down-regulation or reduction with an siNA molecule can be in reference to an inactive molecule, an attenuated molecule, an siNA molecule with a scrambled sequence, or an siNA molecule with mismatches or alternatively, it can be in reference to the system in the absence of the nucleic acid.

The phrase "inhibitors of cell proliferation and survival signaling pathway" refers to pharmaceutical agents that inhibit cell surface receptors and signal transduction cascades downstream of those surface receptors.

The term "integrin blockers" refers to compounds which selectively antagonize, inhibit or counteract binding of a physiological ligand to the $\alpha_{\overline{v}}\beta_3$ integrin, to compounds which selectively antagonize, inhibit or counteract binding of a physiological ligand to the $\alpha_{\overline{v}}\beta_5$ integrin, to compounds which antagonize, inhibit or counteract binding of a physiological ligand to both the $\alpha_{\overline{v}}\beta_3$ integrin and the $\alpha_{\overline{v}}\beta_5$ integrin, and to compounds which antagonize, inhibit or counteract the activity of the particular integrin(s) expressed on capillary endothelial cells. The term also refers to antagonists of the $\alpha_{\overline{v}}\beta_6$ $\alpha_{\overline{v}}\beta_8$ $\alpha_1$ $\beta_1$ $\alpha_2$ $\beta$ $\alpha_5$ $\beta_1$ $\alpha_6$ $\beta_1$ and $\alpha_6\beta_4$ integrins. The term also refers to antagonists of any combination of $\alpha_{\overline{v}}\beta_3$, $\alpha_{\overline{v}}\beta_5$, $\alpha_{\overline{v}}\beta_8$ $\alpha_1$ $\beta_1$ $\alpha_2$ $\beta_1$ $\alpha_5$ $\beta_1$ $\alpha_6$ $\beta_1$ $\alpha_{\overline{v}}\beta_1$ and $\alpha_6\beta_4$ integrins.

The terms "intermittent" or "intermittently" as used herein refers to its meaning as is generally accepted in the art. The term generally refers to periodic stopping and starting at either regular or irregular intervals.

The terms "internucleoside linkage" or "internucleoside linker" or "internucleotide linkage" or "internucleotide linker" are used herein interchangeably and refer to any linker or linkage between two nucleoside units, as is known in the art, including, for example, but not limitation, phosphate, analogs of phosphate, phosphonate, guanidinium, hydroxylamine, hydroxylhydrazinyl, amide, carbamate, alkyl, and substituted alkyl linkages. The internucleoside linkages constitute the backbone of a nucleic acid molecule.

The term "ligand" or refers to such compounds and compositions as are generally known in the art. Non-limiting examples of such ligands are described herein including in the documents specifically incorporated by reference herein. A siNA molecule of the invention can be formulated or administered with any covalently linked ligand as described herein or otherwise known in the art.

The term "lipid nanoparticle" or "LNP" refers to lipid-based compositions and formulations as are generally known in the art. Non-limiting examples of such LNPs are described herein including in the documents specifically incorporated by reference herein. A siNA molecule of the invention can be formulated or administered with any LNP as described herein or otherwise known in the art.

The terms "mammalian" or "mammal" as used herein refers to its meaning as is generally accepted in the art. The term generally refers to any warm blooded vertebrate species, such as a human, mouse, rat, dog, cat, hamster, guinea pig, rabbit, livestock, and the like.

The phrase "metered dose inhaler" or MDI refers to a unit comprising a can, a secured cap covering the can and a formulation metering valve situated in the cap. MDI systems includes a suitable channeling device. Suitable channeling devices comprise for example, a valve actuator and a cylindrical or cone-like passage through which medicament can be delivered from the filled canister via the metering valve to the nose or mouth of a patient such as a mouthpiece actuator.

The term "microRNA" or "miRNA" as used herein refers to its meaning as is generally accepted in the art. The term generally refers to an endogenous short RNA molecule found in eukaryotes that is involved in RNA-based gene regulation. A representative set of known endogenous miRNA species is described in the publicly available miR-Base sequence database as described in Griffith-Jones et al., Nucleic Acids Research, 2004, 32:D109-D111 and Griffith-Jones et al., Nucleic Acids Research, 2006, 34:D 140-D144, accessible on the World Wide Web at the Wellcome Trust Sanger Institute website. Each mature miRNA is partially complementary to one or more messenger RNA (mRNA) molecules, which are also called "miRNA targets," thereby regulating the expression of genes associated with the miRNA targets.

The term "modulate" as used herein refers to its meaning as is generally accepted in the art. With reference to exemplary nucleic acid molecules of the invention, the term refers to when the expression of a gene, or level of one or more RNA molecules (coding or non-coding), or activity of one or more RNA molecules or proteins or protein subunits, is up-regulated or down-regulated, such that expression, level, or activity is greater than or less than that observed in the absence of the molecule that effects modulation. For example, the term "modulate" in some embodiments can refer to inhibition and in other embodiments can refer to potentiation or up-regulation, e.g., of gene expression.

The phrase "modified nucleotide" as used herein refers to its meaning as is generally accepted in the art. The term generally refers a nucleotide, which contains a modification in the chemical structure of the base, sugar and/or phosphate of the unmodified (or natural) nucleotide as is generally known in the art. Non-limiting examples of modified nucleotides are described herein and in U.S. application Ser. No. 12/064,014.

The phrase "NSAIDs that are selective COX-2 inhibitors" for purposes herein, refers to NSAIDs, which possess a specificity for inhibiting COX-2 over COX-1 of at least 100 fold as measured by the ratio of IC50 for COX-2 over IC50 for COX-1 evaluated by cell or microsomal assays.

The phrase "non-base paired" refers to nucleotides that are not base paired between the sense strand or sense region and the antisense strand or antisense region of an double-stranded siNA molecule; and can include for example, but not limitation, mismatches, overhangs, single stranded loops, etc.

The term "non-nucleotide" refers to any group or compound which can be incorporated into a nucleic acid chain in the place of one or more nucleotide units, such as for example but not limitation abasic moieties or alkyl chains. The group or compound is "abasic" in that it does not contain a commonly recognized nucleotide base, such as adenosine, guanine, cytosine, uracil or thymine and therefore lacks a nucleobase at the 1'-position.

The term "nucleotide" is used as is generally recognized in the art. Nucleotides generally comprise a nucleobase, a sugar, and an internucleoside linkage, e.g., a phosphate. The base can be a natural bases (standard), modified bases, or a base analog, as are well known in the art. Such bases are generally located at the 1' position of a nucleotide sugar moiety. Additionally, the nucleotides can be unmodified or modified at the sugar, internucleoside linkage, and/or base moiety, (also referred to interchangeably as nucleotide analogs, modified nucleotides, non-natural nucleotides, non-standard nucleotides and others; see, for example, U.S. application Ser. No. 12/064,014.

The term "overhang" as used herein refers to its meaning as is generally accepted in the art. With reference to exemplary double stranded nucleic acid molecules, the term generally refers to the terminal portion of a nucleotide sequence that is not base paired between the two strands of a double-stranded nucleic acid molecule (see for example, FIGS. 5A-C). Overhangs, when present, are typically at the 3'-end of one or both strands in a siNA duplex.

The term "parenteral" as used herein refers to its meaning as is generally accepted in the art. The term generally refers methods or techniques of administering a molecule, drug, agent, or compound in a manner other than through the digestive tract, and includes epicutaneous, subcutaneous, intravascular (e.g., intravenous), intramuscular, or intrathecal injection or infusion techniques and the like.

The phrase "pathway target" refers to any target involved in pathways of gene expression or activity. For example, any given target can have related pathway targets that can include upstream, downstream, or modifier genes in a biologic pathway. These pathway target genes can provide additive or synergistic effects in the treatment of diseases, conditions, and traits herein.

The term "phosphorothioate" refers to an internucleotide phosphate linkage comprising one or more sulfur atoms in place of an oxygen atom. Hence, the term phosphorothioate refers to both phosphorothioate and phosphorodithioate internucleotide linkages.

The term "polymer" refers to polymeric compounds, compositions and formulations as are generally known in the art. Non-limiting examples of such polymers, including polymeric delivery systems are described herein including in the documents specifically incorporated by reference herein. A siNA molecule of the invention can be formulated or administered with any polymer as described herein or otherwise known in the art.

The term "position 1" refers to the position of the first nucleotide at the end of a strand, e.g., antisense strand. All positions referred to herein are the positions of a nucleotide counting from the end of a strand, for example, positions 1-3 from the 5' end of the antisense strand, refer to the three nucleotides at positions 1, 2, and 3 counting from the 5' end of the antisense strand.

The term "ribonucleotide" as used herein refers to its meaning as is generally accepted in the art. The term generally refers to a nucleotide with a hydroxyl group at the 2' position of a β-D-ribofuranose moiety.

The term "RNA" as used herein refers to its generally accepted meaning in the art. Generally, the term RNA refers to a molecule comprising at least one ribofuranoside moiety. The term can include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the siNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

The phrase "RNA interference" or term "RNAi" refer to the biological process of inhibiting or down regulating gene expression in a cell, as is generally known in the art, and which is mediated by short interfering nucleic acid molecules, see for example Zamore and Haley, 2005, *Science*, 309, 1519-1524; Vaughn and Martienssen, 2005, *Science*, 309, 1525-1526; Zamore et al., 2000, *Cell*, 101, 25-33; Bass, 2001, *Nature*, 411, 428-429; Elbashir et al., 2001, *Nature*, 411, 494-498; and Kreutzer et al., International PCT Publication No. WO 00/44895; Zernicka-Goetz et al., International PCT Publication No. WO 01/36646; Fire, International PCT Publication No. WO 99/32619; Plaetinck et al., International PCT Publication No. WO 00/01846; Mello and Fire, International PCT Publication No. WO 01/29058; Deschamps-Depaillette, International PCT Publication No. WO 99/07409; and Li et al., International PCT Publication No. WO 00/44914; Allshire, 2002, *Science*, 297, 1818-1819; Volpe et al., 2002, *Science*, 297, 1833-1837; Jenuwein, 2002, *Science*, 297, 2215-2218; and Hall et al., 2002, *Science*, 297, 2232-2237; Hutvagner and Zamore, 2002, *Science*, 297, 2056-60; McManus et al., 2002, *RNA*, 8, 842-850; Reinhart et al., 2002, *Gene & Dev.*, 16, 1616-1626; and Reinhart & Bartel, 2002, *Science*, 297, 1831). Additionally, the term RNAi is meant to be equivalent to other terms used to describe sequence specific RNA interference, such as post transcriptional gene silencing, translational inhibition, transcriptional inhibition, or epigenetics. For example, siNA molecules of the invention can be used to epigenetically silence genes at either the post-transcriptional level or the pre-transcriptional level. In a non-limiting example, epigenetic modulation of gene expression by siNA molecules of the invention can result from siNA mediated modification of chromatin structure or methylation patterns to alter gene expression (see, for example, Verdel et al., 2004, *Science*, 303, 672-676; Pal-Bhadra et al., 2004, *Science*, 303, 669-672; Allshire, 2002, *Science*, 297, 1818-1819; Volpe et al., 2002, *Science*, 297, 1833-1837; Jenuwein, 2002, *Science*, 297, 2215-2218; and Hall et al., 2002, *Science*, 297, 2232-2237). In another non-limiting example, modulation of gene expression by siNA molecules of the invention can result from siNA mediated cleavage of RNA (either coding or non-coding RNA) via RISC, or via translational inhibition, as is known in the art or modulation can result from transcriptional inhibition (see for example Janowski et al., 2005, *Nature Chemical Biology*, 1, 216-222).

The phrase "RNAi inhibitor" refers to any molecule that can down regulate, reduce or inhibit RNA interference function or activity in a cell or organism. An RNAi inhibitor can down regulate, reduce or inhibit RNAi (e.g., RNAi mediated cleavage of a target polynucleotide, translational inhibition, or transcriptional silencing) by interaction with or interfering with the function of any component of the RNAi pathway, including protein components such as RISC, or nucleic acid components such as miRNAs or siRNAs. A RNAi inhibitor can be an siNA molecule, an antisense molecule, an aptamer, or a small molecule that interacts with or interferes with the function of RISC, a miRNA, or an siRNA or any other component of the RNAi pathway in a cell or organism. By inhibiting RNAi (e.g., RNAi mediated cleavage of a target polynucleotide, translational inhibition, or transcriptional silencing), a RNAi inhibitor of the invention can be used to modulate (e.g., up-regulate or down regulate) the expression of a target gene.

The phrase "sense region" as used herein refers to its meaning as is generally accepted in the art. With reference to exemplary nucleic acid molecules of the invention, the term refers to a nucleotide sequence of an siNA molecule having complementarity to an antisense region of the siNA molecule. In addition, the sense region of an siNA molecule can comprise a nucleic acid sequence having homology or sequence identity with a target nucleic acid sequence. In one embodiment, the sense region of the siNA molecule is also referred to as the sense strand or passenger strand.

The phrases "short interfering nucleic acid", "siNA", "short interfering RNA", "siRNA", "short interfering nucleic acid molecule", "short interfering oligonucleotide molecule", or "chemically modified short interfering nucleic acid molecule" refer to any nucleic acid molecule capable of inhibiting or down regulating gene expression or viral replication by mediating RNA interference ("RNAi") or gene silencing in a sequence-specific manner. These terms can refer to both individual nucleic acid molecules, a plurality of such nucleic acid molecules, or pools of such nucleic acid molecules. The siNA can be a double-stranded nucleic acid molecule comprising self-complementary sense and antisense strands, wherein the antisense strand comprises a nucleotide sequence that is complementary to a nucleotide sequence in a target nucleic acid molecule or a portion thereof and the sense strand comprises a nucleotide sequence corresponding to the target nucleic acid sequence or a portion thereof. The siNA can be a polynucleotide with a duplex, asymmetric duplex, hairpin or asymmetric hairpin secondary structure, having self-complementary sense and antisense regions, wherein the antisense region comprises a nucleotide sequence that is complementary to a nucleotide sequence in a separate target nucleic acid molecule or a portion thereof and the sense region comprises a nucleotide sequence corresponding to the target nucleic acid sequence or a portion thereof. The siNA can be a circular single-stranded polynucleotide having two or more loop structures and a stem comprising self-complementary sense and antisense regions, wherein the antisense region comprises nucleotide sequence that is complementary to a nucleotide sequence in a target nucleic acid molecule or a portion thereof and the sense region comprises a nucleotide sequence corresponding to the target nucleic acid sequence or a portion thereof, and wherein the circular polynucleotide can be processed either in vivo or in vitro to generate an active siNA molecule capable of mediating RNAi. The siNA can also comprise a single-stranded polynucleotide having a nucleotide sequence complementary to nucleotide sequence in a target nucleic acid molecule or a portion thereof (for example, where such siNA molecule does not require the presence within the siNA molecule of a nucleotide sequence corresponding to the target nucleic acid sequence or a portion thereof), wherein the single-stranded polynucleotide can further comprise a terminal phosphate group, such as a 5'-phosphate (see for example, Martinez et al., 2002, *Cell*, 110, 563-574 and Schwarz et al., 2002, *Molecular Cell*, 10, 537-568), or 5',3'-diphosphate.

The term "subject" as used herein refers to its meaning as is generally accepted in the art. The term generally refers an organism to which the nucleic acid molecules of the invention can be administered. A subject can be a mammal or mammalian cells, including a human or human cells. The term also refers to an organism, which is a donor or recipient of explanted cells or the cells themselves.

The phrase "systemic administration" as used herein refers to its meaning as is generally accepted in the art. The term generally refers in vivo systemic absorption or accumulation of drugs in the blood stream followed by distribution throughout the entire body.

The term "target" as used herein refers, to any protein, peptide, or polypeptide, such as encoded by any gene in the GenBank database, including those described herein and/or in U.S. Provisional Patent Application No. 60/363,124, U.S. application Ser. No. 10/923,536 and/or PCT/US03/05028, all of which are incorporated herein by reference for purposes of identifying such targets. The term "target" also refers to one or more genes, nucleic acid sequences, or target polynucleotide sequences encoding any target protein, peptide, or polypeptide, such as proteins, peptides, or polypeptides encoded by the genes in the Genebank database or sequences having GenBank Accession Nos. shown herein and/or in U.S. Provisional Patent Application No. 60/363,124, U.S. application Ser. No. 10/923,536 and/or PCT/US03/05028, all of which are incorporated herein by reference for purposes of identify such targets. The target of interest can include target polynucleotide sequences, such as target DNA or target RNA. The term "target" is also meant to include other sequences, such as differing isoforms, mutant target genes, splice variants of target polynucleotides, target polymorphisms, and non-coding (e.g., ncRNA, miRNA, stRNA) or other regulatory polynucleotide sequences as described herein. Therefore, in various embodiments of the invention, a double stranded nucleic acid molecule of the invention (e.g., siNA) having complementarity to a target RNA can be used to inhibit or down regulate miRNA or other ncRNA activity. In one embodiment, inhibition of miRNA or ncRNA activity can be used to down regulate or inhibit gene expression (e.g., gene targets described herein or otherwise known in the art) that is dependent on miRNA or ncRNA activity. In another embodiment, inhibition of miRNA or ncRNA activity by double stranded nucleic acid molecules of the invention (e.g. siNA) having complementarity to the miRNA or ncRNA can be used to up regulate or promote target gene expression (e.g., gene targets described herein or otherwise known in the art) where the expression of such genes is down regulated, suppressed, or silenced by the miRNA or ncRNA. Such up-regulation of gene expression can be used to treat diseases and conditions associated with a loss of function or haploinsufficiency as are generally known in the art.

The phrase "target site" as used herein refers to its meaning as is generally accepted in the art. The term generally refers to a sequence within a target nucleic acid molecule, (e.g., RNA) that is "targeted", e.g., for cleavage mediated by an siNA construct, which contains sequences within its antisense region that are complementary to the target sequence.

The phrase "therapeutically effective amount" as used herein refers to its meaning as is generally accepted in the art. The term generally refers to the amount of the compound or composition that will elicit the biological or medical response of a cell, tissue, system, animal or human that is be sought by the researcher, veterinarian, medical doctor or other clinician. For example, if a given clinical treatment is considered effective when there is at least a 25% reduction in a measurable parameter associated with a disease or disorder, a therapeutically effective amount of a drug for the treatment of that disease or disorder is that amount necessary to effect at least a 25% reduction in that parameter.

The phrase "universal base" as used herein refers to its meaning as is generally accepted in the art. The term universal base generally refers to nucleotide base analogs that form base pairs with each of the natural DNA/RNA bases with little or no discrimination between them. Non-limiting examples of universal bases include C-phenyl, C-naphthyl and other aromatic derivatives, inosine, azole carboxamides, and nitroazole derivatives such as 3-nitropyrrole, 4-nitroindole, 5-nitroindole, and 6-nitroindole as known in the art (see for example, Loakes, 2001, Nucleic Acids Research, 29, 2437-2447).

The term "up-regulate" as used herein refers to its meaning as is generally accepted in the art. With reference to exemplary nucleic acid molecules of the invention, the term refers to an increase in the expression of a gene, or level of RNA molecules or equivalent RNA molecules encoding one or more proteins or protein subunits, or activity of one or more RNAs, proteins or protein subunits, above that observed in the absence of the nucleic acid molecules (e.g., siNA) of the invention. In certain instances, up-regulation or promotion of gene expression with an siNA molecule is above that level observed in the presence of an inactive or attenuated molecule. In other instances, up-regulation or promotion of gene expression with siNA molecules is above that level observed in the presence of, for example, an siNA molecule with scrambled sequence or with mismatches. In still other instances, up-regulation or promotion of gene expression with a nucleic acid molecule of the instant invention is greater in the presence of the nucleic acid molecule than in its absence. In some instances, up-regulation or promotion of gene expression is associated with inhibition of RNA mediated gene silencing, such as RNAi mediated cleavage or silencing of a coding or non-coding RNA target that down regulates, inhibits, or silences the expression of the gene of interest to be up-regulated. The down regulation of gene expression can, for example, be induced by a coding RNA or its encoded protein, such as through negative feedback or antagonistic effects. The down regulation of gene expression can, for example, be induced by a non-coding RNA having regulatory control over a gene of interest, for example by silencing expression of the gene via translational inhibition, chromatin structure, methylation, RISC mediated RNA cleavage, or translational inhibition. As such, inhibition or down regulation of targets that down regulate, suppress, or silence a gene of interest can be used to up-regulate expression of the gene of interest toward therapeutic use.

The term "vector" as used herein refers to its meaning as is generally accepted in the art. The term vector generally refers to any nucleic acid- and/or viral-based expression system or technique used to deliver one or more nucleic acid molecules.

B. siNA Molecules of the Invention

The present invention provides compositions and methods comprising siNAs having target specificity that can be used to treat diseases and conditions herein or otherwise known in the art that are associated with gene expression. In particular aspects and embodiments of the invention, the nucleic acid molecules of the invention comprise at least a 15 nucleotide sequence of the a target sequence, and/or comprises a nucleotide sequence of at least 15 nucleotides complimentary to the target sequence). The siNAs can be provided in several forms. For example, the siNA can be isolated as one or more siNA compounds, or it may be in the form of a transcriptional cassette in a DNA plasmid. The siNA may also be chemically synthesized and can include modifications as shown, for example, but not limitation, in Table 1 and Table 8. The siNAs can be administered alone or co-administered with other siNA molecules or with conventional agents that treat a gene related disease or condition as described herein or otherwise known in the art.

The siNA molecules of the invention can be used to mediate gene silencing via interaction with RNA transcripts or alternately by interaction with particular gene sequences, wherein such interaction results in modulation of gene silencing either at the transcriptional level or post-transcriptional level such as, for example, but not limited to, RNAi or through cellular processes that modulate the chromatin structure or methylation patterns of the target and prevent transcription of the target gene, with the nucleotide sequence of the target thereby mediating silencing. More specifically, the target is any GenBank reference sequence as is presently known in the art.

In one aspect, the invention provides short interfering nucleic acid (siNA) molecules for inhibiting the expression of the target gene in a cell or mammal. The siNA can be single-stranded or double-stranded. When double-stranded, the siNA comprising a sense and an antisense stand. The antisense strand is complementary to at least a part of an mRNA formed in the expression of the HBV gene. The sense strand comprises a region that is complementary to the antisense strand. One or more of the nucleotides of the siNAs of the invention are optionally modified The double stranded RNA molecules of the invention can comprise two distinct and separate strands that can be symmetric or asymmetric and are complementary, i.e., two single-stranded RNA molecules, or can comprise one single-stranded molecule in which two complementary portions, e.g., a sense region and an antisense region, are base-paired, and are covalently linked by one or more single-stranded "hairpin" areas (i.e. loops) resulting in, for example, a single-stranded short-hairpin polynucleotide or a circular single-stranded polynucleotide.

The linker can be polynucleotide linker or a non-nucleotide linker. In some embodiments, the linker is a non-nucleotide linker. In some embodiments, a hairpin or circular siNA molecule of the invention contains one or more loop motifs, wherein at least one of the loop portions of the siNA molecule is biodegradable. For example, a single-stranded hairpin siNA molecule of the invention is designed such that degradation of the loop portion of the siNA molecule in vivo can generate a double-stranded siNA molecule with 3'-terminal overhangs, such as 3'-terminal nucleotide overhangs comprising 1, 2, 3 or 4 nucleotides. Or alternatively, a circular siNA molecule of the invention is designed such that degradation of the loop portions of the siNA molecule in vivo can generate a double-stranded siNA molecule with 3'-terminal overhangs, such as 3'-terminal nucleotide overhangs comprising about 2 nucleotides.

In some embodiments, siNA molecules of the invention have perfect complementarity between the sense strand or sense region and the antisense strand or antisense region of the siNA molecule. In other or the same embodiments, the antisense strand of the siNA molecules of the invention are perfectly complementary to a corresponding target nucleic acid molecule.

In yet other embodiments, siNA molecules of the invention have partial complementarity (i.e., less than 100% complementarity) between the sense strand or sense region and the antisense strand or antisense region of the siNA molecule or between the antisense strand or antisense region of the siNA molecule and a corresponding target nucleic acid molecule. Thus, in some embodiments, the double-stranded nucleic acid molecules of the invention, have between about 15 to about 30 (e.g., about 15, 16, 17, 18, 19, 20, 21, 22, 23, 24, 25, 26, 27, 28, 29, or 30) nucleotides in one strand that are complementary to the nucleotides of the other strand. In other embodiments, the molecules have between about 15 to about 30 (e.g., about 15, 16, 17, 18, 19, 20, 21, 22, 23, 24, 25, 26, 27, 28, 29, or 30) nucleotides in the sense region that are complementary to the nucleotides of the antisense region of the double-stranded nucleic acid molecule. In certain embodiments, the double-stranded nucleic acid molecules of the invention have between about 15 to about 30 (e.g., about 15, 16, 17, 18, 19, 20, 21, 22, 23, 24, 25, 26, 27, 28, 29, or 30) nucleotides in the antisense strand that are complementary to a nucleotide sequence of its corresponding target nucleic acid molecule.

In other embodiments, the siNA molecule can contain one or more nucleotide deletions, substitutions, mismatches and/or additions; provided, however, that the siNA molecule maintains its activity, for example, to mediate RNAi. In a non-limiting example, the deletion, substitution, mismatch and/or addition can result in a loop or bulge, or alternately a wobble or other alternative (non Watson-Crick) base pair. Thus, in some embodiments, for example, the double-stranded nucleic acid molecules of the invention, have 1 or more (e.g., 1, 2, 3, 4, 5, or 6) nucleotides, in one strand or region that are mismatches or non-base-paired with the other strand or region . . . . In other embodiments, the double-stranded nucleic acid molecules of the invention, have 1 or more (e.g., 1, 2, 3, 4, 5, or 6) nucleotides in each strand or region that are mismatches or non-base-paired with the other strand or region. In a preferred embodiment, the siNA of the invention contains no more than 3 mismatches. If the antisense strand of the siNA contains mismatches to a target sequence, it is preferable that the area of mismatch not be located in the center of the region of complementarity.

In other embodiments, the siNA molecule can contain one or more nucleotide deletions, substitutions, mismatches and/or additions to a sequence provided herein, however, that the siNA molecule maintains its activity, for example, to mediate RNAi. In a non-limiting example, the deletion, substitution, mismatch and/or addition can result in a loop or bulge, or alternately a wobble or other alternative (non Watson-Crick) base pair.

The invention also comprises double-stranded nucleic acid (siNA) molecules as otherwise described hereinabove in which the first strand and second strand are complementary to each other and wherein at least one strand is hybridisable to the polynucleotide sequence of a target sequence under conditions of high stringency, and wherein any of the nucleotides is unmodified or chemically modified.

Hybridization techniques are well known to the skilled artisan (see for instance, Sambrook et al., Molecular Cloning: A Laboratory Manual, 2nd Ed., Cold Spring Harbor Laboratory Press, Cold Spring Harbor, N.Y. (1989)). Preferred stringent hybridization conditions include overnight incubation at 42° C. in a solution comprising: 50% formamide, 5×SSC (150 mM NaCl, 15 mM trisodium citrate), 50 mM sodium phosphate (pH 7.6), 5×Denhardt's solution, 10% dextran sulfate, and 20 microgram/ml denatured, sheared salmon sperm DNA; followed by washing the filters in 0.1×SSC at about 65° C.

In some embodiments, the first strand has about 15, 16, 17, 18, 19, 20 or 21 nucleotides that are complementary to the nucleotides of the other strand and at least one strand is hybridisable to target sequence such as a gene in the GenBank database. In a more preferred embodiment, the first strand has about 15, 16, 17, 18, 19, 20 or 21 nucleotides that are complementary to the nucleotides of the other strand and at least one strand is hybridisable at least one strand is hybridisable to the complement of a target sequence under conditions of high stringency; and wherein any of the nucleotides is unmodified or chemically modified except that positions 1-3 of the 5' end of the antisense strand are modified.

In certain embodiments, the siNA molecules of the invention comprise overhangs of about 1 to about 4 (e.g., about 1, 2, 3 or 4) nucleotides. The nucleotides in the overhangs can be the same or different nucleotides. In some embodiments, the overhangs occur at the 3'-end at one or both strands of the double-stranded nucleic acid molecule. For example, a double-stranded nucleic acid molecule of the invention can comprise a nucleotide or non-nucleotide overhang at the 3'-end of the antisense strand/region, the 3'-end of the sense strand/region, or both the antisense strand/region and the sense strand/region of the double-stranded nucleic acid molecule.

In some embodiments, the nucleotides comprising the overhang portion of an siNA molecule of the invention comprise sequences based on the target polynucleotide sequence in which nucleotides comprising the overhang portion of the antisense strand/region of an siNA molecule of the invention can be complementary to nucleotides in the target polynucleotide sequence and/or nucleotides comprising the overhang portion of the sense strand/region of an siNA molecule of the invention can comprise the nucleotides in the target polynucleotide sequence. Thus, in some embodiments, the overhang comprises a two nucleotide overhang that is complementary to a portion of the target polynucleotide sequence. In other embodiments, however, the overhang comprises a two nucleotide overhang that is not complementary to a portion of the target polynucleotide sequence. In certain embodiments, the overhang comprises a 3'-UU overhang that is not complementary to a portion of the target polynucleotide sequence. In other embodiments, the overhang comprises a UU overhang at the 3' end of the antisense strand and a TT overhang at the 3' end of the sense strand. In other embodiments, the overhang comprises nucleotides as described in the examples, Tables, and Figures herein.

In any of the embodiments of the siNA molecules described herein having 3'-terminal nucleotide overhangs, the overhangs are optionally chemically modified at one or more nucleic acid sugar, base, or backbone positions. Representative, but not limiting examples of modified nucleotides in the overhang portion of a double-stranded nucleic acid (siNA) molecule of the invention include: 2'-O-alkyl (e.g., 2'-O-methyl), 2'-deoxy, 2'-deoxy-2'-fluoro, 2'-deoxy-2'-fluoroarabino (FANA), 4'-thio, 2'-O-trifluoromethyl, 2'-O-ethyl-trifluoromethoxy, 2'-O-difluoromethoxy-ethoxy, universal base, acyclic, or 5-C-methyl nucleotides. In more preferred embodiments, the overhang nucleotides are each independently, a 2'-O-alkyl nucleotide, a 2'-O-methyl nucleotide, a 2'-dexoy-2-fluoro nucleotide, or a 2'-deoxy ribonucleotide. In some instances the overhang nucleotides are linked by a one or more phosphorothioate linkages.

In yet other embodiments, siNA molecules of the invention comprise duplex nucleic acid molecules with blunt ends (i.e., without nucleotide overhangs), where both ends are blunt, or alternatively, where one of the ends is blunt. In some embodiments, the siNA molecules of the invention can comprises one blunt end, for example wherein the 5'-end of the antisense strand and the 3'-end of the sense strand do not have any overhanging nucleotides. In another example, the siNA molecule comprises one blunt end, for example wherein the 3'-end of the antisense strand and the 5'-end of the sense strand do not have any overhanging nucleotides. In other embodiments, siNA molecules of the invention comprise two blunt ends, for example wherein the 3'-end of the antisense strand and the 5'-end of the sense strand as well as the 5'-end of the antisense strand and 3'-end of the sense strand do not have any overhanging nucleotides.

In any of the embodiments or aspects of the siNA molecules of the invention, the sense strand and/or the antisense strand can further have a cap, such as described herein or as known in the art, at the 3'-end, the 5'-end, or both of the 3' and 5'-ends of the sense strand and/or antisense strand. Or as in the case of a hairpin siNA molecule, the cap can be at either one or both of the terminal nucleotides of the polynucleotide. In some embodiments, the cap is at one of both of the ends of the sense strand of a double-stranded siNA molecule. In other embodiments, the cap is at the 3'-end of antisense (guide) strand. In preferred embodiments, the caps are at the 3'-end of the sense strand and the 5'-end of the sense strand.

Representative, but non-limiting examples of such terminal caps include an inverted abasic nucleotide, an inverted deoxy abasic nucleotide, an inverted nucleotide moiety, a group shown in FIG. 6 or FIG. 10, a glyceryl modification, an alkyl or cycloalkyl group, a heterocycle, or any other cap as is generally known in the art.

Any of the embodiments of the siNA molecules of the invention can have a 5' phosphate termini. In some embodiments, the siNA molecules lack terminal phosphates.

Any siNA molecule or construct of the invention can comprise one or more chemical modifications. Modifications can be used to improve in vitro or in vivo characteristics such as stability, activity, toxicity, immune response (e.g., prevent stimulation of an interferon response, an inflammatory or pro-inflammatory cytokine response, or a Toll-like Receptor (TIF) response), and/or bioavailability.

Applicants describe herein chemically modified siNA molecules with improved RNAi activity and/or stability compared to corresponding unmodified siNA molecules. Various chemically modified siNA motifs disclosed herein provide the capacity to maintain RNAi activity that is substantially similar to unmodified or minimally modified active siRNA (see for example Elbashir et al., 2001, EMBO J., 20:6877-6888) while at the same time providing nuclease resistance and pharmacokinetic properties suitable for use in therapeutic applications.

In various embodiments, the siNA molecules of the invention comprise modifications wherein any (e.g., one or more or all) nucleotides present in the sense and/or antisense strand are modified nucleotides (e.g., wherein one nucleotide is modified, some nucleotides (i.e., plurality or more than one) are modified, or all nucleotides are modified nucleotides. In some embodiments, the siNA molecules of the invention are partially modified (e.g., about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59 or 60 nucleotides are modified) with chemical modifications. In some embodiments, an siNA molecule of the invention comprises at least about 8, 10, 12, 14, 16, 18, 20, 22, 24, 26, 28, 30, 32, 34, 36, 38, 40, 42, 44, 46, 48, 50, 52, 54, 56, 58, or 60 nucleotides that are modified nucleotides. In other embodiments, the siNA molecules of the invention are completely modified (e.g., 100% modified) with chemical modifications, i.e., the siNA molecule does not contain any ribonucleotides. In some of embodiments, one or more of the nucleotides in the sense strand of the siNA molecules of the invention are modified. In the same or other embodiments, one or more of the nucleotides in the antisense strand of the siNA molecules of the invention are modified.

The chemical modification within a single siNA molecule can be the same or different. In some embodiments, at least one strand has at least one chemical modification. In other embodiments, each strand has at least one chemical modifications, which can be the same or different, such as, sugar, base, or backbone (i.e., internucleotide linkage) modifications. In other embodiments, siNA molecules of the invention contain at least 2, 3, 4, 5, or more different chemical modifications.

Non-limiting examples of chemical modifications that are suitable for use in the present invention, are disclosed in U.S. patent application Ser. Nos. 10/444,853; 10/981,966; 12/064,014 and in references cited therein and include sugar, base, and phosphate, non-nucleotide modifications, and/or any combination thereof.

In certain specific embodiments of the invention, at least one modified nucleotide is a 2'-deoxy-2-fluoro nucleotide, a 2'-deoxy nucleotide, a 2'-O-alkyl (e.g., 2'-O-methyl) nucleotide, or a locked nucleic acid (LNA) nucleotide as is generally recognized in the art.

In yet other embodiment of the invention, at least one nucleotide has a ribo-like, Northern or A form helix configuration (see e.g., Saenger, Principles of Nucleic Acid Structure, Springer-Verlag ed., 1984). Non-limiting examples of nucleotides having a Northern configuration include locked nucleic acid (LNA) nucleotides (e.g., 2'-0, 4'-C-methylene-(D-ribofuranosyl) nucleotides); 2'-methoxyethoxy (MOE) nucleotides; 2'-methyl-thio-ethyl nucleotides, 2'-deoxy-2'-fluoro nucleotides; 2'-deoxy-2'-chloro nucleotides; 2'-azido nucleotides; 2'-O-trifluoromethyl nucleotides; 2'-O-ethyl-trifluoromethoxy nucleotides; 2'-O-difluoromethoxy-ethoxy nucleotides; 4'-thio nucleotides and 2'-O-methyl nucleotides.

In various embodiments, a majority (e.g., greater than 50%) of the pyrimidine nucleotides present in the double-stranded siNA molecule comprises a sugar modification. In some of the same and/or other embodiments, a majority (e.g., greater than 50%) of the purine nucleotides present in the double-stranded siNA molecule comprises a sugar modification.

In some embodiments, the pyrimidine nucleotides in the antisense strand are 2'-O-methyl or 2'-deoxy-2'-fluoro pyrimidine nucleotides and the purine nucleotides present in the antisense strand are 2'-O-methyl nucleotides or 2'-deoxy nucleotides. In other embodiments, the pyrimidine nucleotides in the sense strand are 2'-deoxy-2'-fluoro pyrimidine nucleotides and the purine nucleotides present in the sense strand are 2'-O-methyl or 2'-deoxy purine nucleotides.

In certain embodiments of the invention, all the pyrimidine nucleotides in the complementary region on the sense strand are 2'-deoxy-2'-fluoro pyrimidine nucleotides. In certain embodiments, all of the pyrimidine nucleotides in the complementary region of the antisense strand are 2'-deoxy-2'-fluoro pyrimidine nucleotides. In certain embodiments, all the purine nucleotides in the complementary region on the sense strand are 2'-deoxy purine nucleotides. In certain embodiments, all of the purines in the complementary region on the antisense strand are 2'-O-methyl purine nucleotides. In certain embodiments, all of the pyrimidine nucleotides in the complementary regions on the sense strand are 2'-deoxy-2'-fluoro pyrimidine nucleotides; all of the pyrimidine nucleotides in the complementary region of the antisense strand are 2'-deoxy-2'-fluoro pyrimidine nucleotides; all the purine nucleotides in the complementary region on the sense strand are 2'-deoxy purine nucleotides and all of the purines in the complementary region on the antisense strand are 2'-O-methyl purine nucleotides.

In some embodiments, at least 5 or more of the pyrimidine nucleotides in one or both stands are 2'-deoxy-2'-fluoro pyrimidine nucleotides. In some embodiments, at least 5 or more of the pyrimidine nucleotides in one or both stands are 2'-O-methyl pyrimidine nucleotides. In some embodiments, at least 5 or more of the purine nucleotides in one or both stands are 2'-deoxy-2'-fluoro purine nucleotides. In some embodiments, at least 5 or more of the purine nucleotides in one or both stands are 2'-O-methyl purine nucleotides.

In some embodiments, at least 5 or more of the pyrimidine nucleotides in one or both strands are 2'-O-methyl nucleotides and at least 5 or more of the purine nucleotides are 2'-deoxy-2-fluoro nucleotides. In some embodiments, at least 5, 6, 7, 8, 9, 10 or more of the pyrimidine nucleotides in one or both strands are 2'-O-methyl nucleotides and at least 5, 6, 7, 8, 9, 10 or more of the purine nucleotides are 2'-deoxy-2-fluoro nucleotides. In some embodiments, at least 5 or more of the purine nucleotides in one or both stands are 2'-deoxy-2-fluoro purine nucleotides.

In certain embodiments, the purines and pyrimidines are differentially modified at the 2'-sugar position (i.e., at least one purine has a different modification from at least one pyrimidine in the same or different strand at the 2'-sugar position). For example, in some instances, at least 5 or more of the pyrimidine nucleotides in one or both stands are 2'-deoxy-2'-fluoro pyrimidine nucleotides and at least 5 or more purine nucleotides in one or both stands are 2'-O-methyl purine nucleotides. In other instances at least 5 or more of the pyrimidine nucleotides in one or both strands are 2'-O-methyl pyrimidine nucleotides and at least 5 or more purine nucleotides in one or both strands are 2'-deoxy-2'-fluoro purine nucleotides.

Further non-limiting examples of sense and antisense strands of such siNA molecules having various modifications are shown in FIGS. 2A-4 and Table 8.

Any of the above described modifications, or combinations thereof, including those in the references cited, can be applied to any of the siNA molecules of the invention.

The modified siNA molecules of the invention can comprise modifications at various locations within the siNA molecule. In some embodiments, the double-stranded siNA molecule of the invention comprises modified nucleotides at internal base paired positions within the siNA duplex. In other embodiments, a double-stranded siNA molecule of the invention comprises modified nucleotides at non-base paired or overhang regions of the siNA molecule. In yet other embodiments, a double-stranded siNA molecule of the invention comprises modified nucleotides at terminal positions of the siNA molecule. For example, such terminal regions include the 3'-position and/or 5'-position of the sense and/or antisense strand or region of the siNA molecule. Additionally, any of the modified siNA molecules of the invention can have a modification in one or both oligonucleotide strands of the siNA duplex, for example in the sense strand, the antisense strand, or both strands. Moreover, with regard to chemical modifications of the siNA molecules of the invention, each strand of the double-stranded siNA molecules of the invention can have one or more chemical modifications, such that each strand comprises a different motif of chemical modifications.

In certain embodiments each strand of a double-stranded siNA molecule of the invention comprises a different motif of chemical modifications, such as any Stab modification chemistries described herein (see Table 8) or any combination thereof, i.e., different combinations of defined Stabilization chemistry (Stab) sense and antisense strands. Further, non-limiting examples of modification schemes that could give rise to different motifs of modifications are shown in Table 8. The stabilization chemistries referred to in Table 8 as Stab, can be combined in any combination of sense/antisense chemistries, such as Stab 7/8, Stab 7/11, Stab 8/8, Stab 18/8, Stab 18/11, Stab 12/13, Stab 7/13, Stab 18/13, Stab 7/19, Stab 8/19, Stab 18/19, Stab 7/20, Stab 8/20, Stab 18/20, Stab 7/32, Stab 8/32, or Stab 18/32 or any other combination of Stabilization chemistries.

In any of the siNAs of the invention, one or more (for example 1, 2, 3, 4 or 5) nucleotides at the 5'-end of the guide strand or guide region (also known as antisense strand or antisense region) of the siNA molecule are ribonucleotides.

Any of the above described modifications, or combinations thereof, including those in the references cited, can be applied to any of these embodiments.

In certain embodiments of the present invention, double-stranded siNA molecules are provided that modulate the expression of a target gene via RNA interference, wherein the molecule has a sense strand and an antisense strand and comprises structure represented by formula (A):

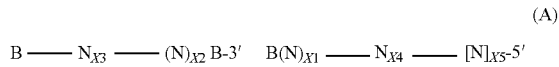

(A)

wherein, the upper strand is the sense strand and the lower strand is the antisense strand of the double-stranded nucleic acid molecule; wherein the antisense strand comprises a sequence having at least 15 nucleotides that are complementary to a target RNA sequence encoded by the target gene and the sense strand comprises a sequence that is complementarity to the antisense strand;

each N is independently a nucleotide which is unmodified or chemically modified or is optionally a non-nucleotide;

each B is independently a terminal cap that is present or absent;

(N) represents overhanging nucleotides, each of which is independently unmodified or chemically modified;

[N] represents nucleotides at the 5'-terminus of the antisense strand;

X1 and X2 are independently integers from 0 to 4;

X3 is an integer from 15 to 30;

X4 is an integer from 12 to 27; and

X5 is an integer from 1-6, provided that the sum of X4 and X5 is an integer from 15-30.

Any of the above described modifications, or combinations thereof, including those in the references cited, can be applied to any of these embodiments.

In certain embodiments, the nucleotides of the antisense strand sequence having at least 15 nucleotides complementary to a target sequence form a contiguous stretch of nucleotides.

In some embodiments, the siNA molecule of formula A can contain one or more nucleotide deletions, substitutions, mismatches and/or additions to the antisense strand sequence having at least 15 nucleotides complementary to a target sequence provided, however, that the siNA molecule maintains its activity, for example, to mediate RNAi. In a non-limiting example, the deletion, substitution, mismatch and/or addition can result in a loop or bulge, or alternately a wobble or other alternative (non Watson-Crick) base pair.

In one embodiment, the invention features a double-stranded short interfering nucleic acid (siNA) of formula (A); wherein
- one or more pyrimidine nucleotides in $N_{X4}$ positions are independently 2'-deoxy-2'-fluoro nucleotides, 2'-O-alkyl nucleotides, 2'-deoxy nucleotides, ribonucleotides, or any combination thereof;
- one or more purine nucleotides in $N_{X4}$ positions are independently 2'-deoxy-2'-fluoro nucleotides, 2'-O-alkyl nucleotides, 2'-deoxy nucleotides, ribonucleotides, or any combination thereof;
- one or more pyrimidine nucleotides in $N_{X3}$ positions are independently 2'-deoxy-2'-fluoro nucleotides, 2'-O-alkyl nucleotides, 2'-deoxy nucleotides, ribonucleotides, or any combination thereof;
- one or more purine nucleotides in $N_{X3}$ positions are independently 2'-deoxy-2'-fluoro nucleotides, 2'-O-alkyl nucleotides, 2'-deoxy nucleotides, ribonucleotides, or any combination thereof; and
- [N] position nucleotide(s) are ribonucleotides, deoxyribonucleotides, 2'-O-alkyl nucleotides, 2'-halo nucleotides, or any combination thereof irrespective of purine or pyrimidine content.

In certain embodiments, the invention features a double-stranded short interfering nucleic acid (siNA) molecule of formula (A); wherein
- 5, 6, 7, 8, 9, 10 or more pyrimidine nucleotides in $N_{X4}$ positions are 2'-deoxy-2'-fluoro nucleotides;
- 5, 6, 7, 8, 9, 10 or more purine nucleotides in $N_{X4}$ positions are 2'-O-alkyl nucleotides;
- 5, 6, 7, 8, 9, 10 or more pyrimidine nucleotides in $N_{X3}$ positions are 2'-deoxy-2'-fluoro nucleotides; and
- 5, 6, 7, 8, 9, 10 or more purine nucleotides in $N_{X3}$ positions are 2'-deoxy nucleotides.

In certain embodiments, the invention features a double-stranded short interfering nucleic acid (siNA) molecule of formula (A); wherein
- 5, 6, 7, 8, 9, 10 or more pyrimidine nucleotides in $N_{X4}$ positions are 2'-O-alkyl nucleotides;
- 5, 6, 7, 8, 9, 10 or more purine nucleotides in $N_{X4}$ positions are ribonucleotides;
- 5, 6, 7, 8, 9, 10 or more pyrimidine nucleotides in $N_{X3}$ positions are 2'-O-alkyl nucleotides; and
- 5, 6, 7, 8, 9, 10 or more purine nucleotides in $N_{X3}$ positions are ribonucleotides.

In certain embodiments, the invention features a double-stranded short interfering nucleic acid (siNA) molecule of formula (A); wherein
- 5, 6, 7, 8, 9, 10 or more pyrimidine nucleotides in $N_{X4}$ positions are 2'-deoxy-2'-fluoro nucleotides;
- 5, 6, 7, 8, 9, 10 or more purine nucleotides in $N_{X4}$ positions are 2'-O-alkyl nucleotides;
- 5, 6, 7, 8, 9, 10 or more pyrimidine nucleotides in $N_{X3}$ positions are 2'-O-alkyl nucleotides; and
- 5, 6, 7, 8, 9, 10 or more purine nucleotides in $N_{X3}$ positions are 2'-deoxy-2'-fluoro nucleotides.

With respect to any siNA having Formula (A) described herein, in certain embodiments, [N] nucleotides comprise ribonucleotides, deoxyribonucleotides, 2'-deoxy-2'-fluoro nucleotides, 2'-O-alkyl nucleotides, or any combination thereof. In other embodiments, one or more, e.g., 1, 2, 3, 4, 5, or 6 [N] nucleotide positions optionally comprise a phosphorothioate internucleotide linkage.

With respect to any siNA having Formula (A) described herein, in certain embodiments, [N] nucleotides are ribonucleotides. In other embodiments, one or more, e.g., 1, 2, 3, 4, 5, or 6 [N] ribonucleotide positions optionally comprise a phosphorothioate internucleotide linkage.

With respect to any siNA having Formula (A) described herein, in certain embodiments, [N] nucleotides are 2'-deoxy-2'-fluoro nucleotides. In other embodiments, one or more, e.g., 1, 2, 3, 4, 5, or 6 [N] 2'-deoxy-2'-fluoro nucleotide positions optionally comprise a phosphorothioate internucleotide linkage.

With respect to any siNA having Formula (A) described herein, in certain embodiments, [N] nucleotides are 2'-deoxy nucleotides. In other embodiments, one or more, e.g., 1, 2, 3, 4, 5, or 6 [N] 2'-deoxy nucleotide positions optionally comprise a phosphorothioate internucleotide linkage.

With respect to any siNA having Formula (A) described herein, in certain embodiments, [N] nucleotides are 2'-O-alkyl nucleotides. In other embodiments, one or more, e.g., 1, 2, 3, 4, 5, or 6 [N] 2'-O-alkyl nucleotide positions optionally comprise a phosphorothioate internucleotide linkage.

With respect to any siNA having Formula (A) described herein, in certain embodiments, X5=3, wherein the three [N] nucleotides of formula (A) are represented as 5'-[N1, N2, N3]-3', wherein:
- each N1, N2, and N3 is a ribonucleotide; or
- each N1, N2, and N3 is a 2'-deoxy-2'-fluoro nucleotide; or
- each N1, N2, and N3 is a 2'-deoxy nucleotide; or
- each N1, N2, and N3 is a 2'-O-alkyl nucleotide; and
- any of N1, N2, or N3 optionally comprises a phosphorothioate internucleotide linkage.

With respect to any siNA having Formula (A) described herein, in certain embodiments, X5=3, wherein the three [N] nucleotides of formula (A) are represented as 5'-[N1, N2, N3]-3', wherein:
- N1 is a 2'-deoxy-2'-fluoro nucleotide, N2 is 2'-deoxy-2'-fluoro nucleotide, and N3 is a 2'-deoxynucleotide; and
- any of N1, N2, or N3 optionally comprises a phosphorothioate internucleotide linkage.

With respect to any siNA having Formula (A) described herein, in certain embodiments, X5=3, wherein the three [N] nucleotides of formula (A) are represented as 5'-[N1, N2, N3]-3', wherein:
- N1 is a 2'-deoxy-2'-fluoro nucleotide, N2 is 2'-deoxy-2'-fluoro nucleotide, and N3 is a 2'-deoxy-2'-fluoro nucleotide; and
- any of N1, N2, or N3 optionally comprises a phosphorothioate internucleotide linkage.

With respect to any siNA having Formula (A) described herein, in certain embodiments, X5=3, wherein the three [N] nucleotides of formula (A) are represented as 5'-[N1, N2, N3]-3', wherein:
- N1 is a 2'-deoxy nucleotide, N2 is 2'-deoxy-2'-fluoro nucleotide, and N3 is a 2'-O-alkyl nucleotide; and
- any of N1, N2, or N3 optionally comprises a phosphorothioate internucleotide linkage.

With respect to any siNA having Formula (A) described herein, in certain embodiments, X5=3, wherein the three [N] nucleotides of formula (A) are represented as 5'-[N1, N2, N3]-3', wherein:
- N1 is a 2'-deoxy nucleotide, N2 is 2'-deoxy-2'-fluoro nucleotide, and N3 is a 2'-deoxy nucleotide; and
- any of N1, N2, or N3 optionally comprises a phosphorothioate internucleotide linkage.

In certain embodiments of the present invention, double-stranded siNA molecules are provided that modulate the expression of a target gene via RNA interference, wherein the molecule has a sense strand and an antisense strand and comprises structure represented by formula (A):

wherein, the upper strand is the sense strand and the lower strand is the antisense strand of the double-stranded nucleic acid molecule; wherein the antisense strand comprises a sequence having at least 15 nucleotides that are complementary to a target RNA sequence encoded by the target gene and the sense strand comprises a sequence that is complementarity to the antisense strand; each N is independently a nucleotide which is unmodified or chemically modified or is optionally a non-nucleotide; each B is independently a terminal cap that is present or absent; (N) represents overhanging nucleotides, each of which is independently unmodified or chemically modified; [N] represents nucleotides at the 5'-terminus of the antisense strand; X1 and X2 are independently integers from 0 to 4; X3 is an integer from 15 to 30; X4 is an integer from 12 to 27; and X5 is an integer from 1-6, provided that the sum of X4 and X5 is an integer from 15-30; and wherein (a) all pyrimidine nucleotides in $N_{X4}$ positions are 2'-O-alkyl nucleotides;
(b) all purine nucleotides in $N_{X4}$ positions are 2'-halo nucleotides;
(c) all pyrimidine nucleotides in $N_{X3}$ positions are 2'-O-alkyl nucleotides;
(d) all purine nucleotides in $N_{X3}$ positions are 2'-halo nucleotides; and
(e) [N] position nucleotide(s) are any combination of ribonucleotides, deoxyribonucleotides, 2'-O-alkyl nucleotides, or 2'-halo nucleotides;
(f) the nucleotide at position 14 from the 5'-end of the antisense strand is a 2'-deoxy-2'-fluoro nucleotide regardless of whether it is a purine or pyrimidine; and
(g) [N] nucleotides of formula (A) are represented as 5'-[N1, N2, N3]-3', wherein
 i) N1 is a 2'-deoxy nucleotide, N2 is 2'-deoxy-2'-fluoro nucleotide, and N3 is a 2'-deoxy nucleotide; or
 ii) N1 is a 2'-deoxy-2'-fluoro nucleotide, N2 is 2'-deoxy-2'-fluoro nucleotide, and N3 is a 2'-deoxy-2'-fluoro nucleotide; or
 iii) N1 is a 2'-deoxy-2'-fluoro nucleotide, N2 is 2'-deoxy-2'-fluoro nucleotide, and N3 is a 2'-deoxynucleotide; or
 iv) N1 is a 2'-deoxy nucleotide, N2 is 2'-deoxy-2'-fluoro nucleotide, and N3 is a 2'-O-methyl nucleotide; or
 v) N1, N2, and N3 are all ribonucleotides having phosphorothioate internucleotide linkages.

With respect to any siNA having Formula (A) described herein, in certain embodiments, the invention features a double-stranded short interfering nucleic acid (siNA) molecule of formula (A) further comprising one or more phosphorothioate internucleotide linkages at any $N_{X1}$, $N_{X2}$, $N_{X3}$, $N_{X4}$, or $N_{X5}$ position, or any combination thereof.

In some embodiments, siNA molecules having formula A comprise a terminal phosphate group at the 5'-end of the antisense strand or antisense region of the nucleic acid molecule.

In various embodiments, siNA molecules having formula A comprise X5=0, 1, 2, or 3; each X1 and X2=1 or 2; X3=18, 19, 20, 21, 22, or 23, and X4=17, 18, 19, 20, 21, 22, or 23.

In certain embodiments, siNA molecules having formula A comprise X5=3. In other embodiments siNA molecules having formula A comprise X5=0.

In certain embodiments, siNA molecules having formula A comprise X1=2 and X2=2.

In various embodiments, siNA molecules having formula A comprise X5=0, X1=2, and X2=2. In other embodiments, siNA molecules having formula A comprise X5=3, X1=2, and X2=2.

In one specific embodiment, an siNA molecule having formula A comprises X5=3; each X1 and X2=2; X3=19, and X4=16.

In certain embodiments, siNA molecules having formula A comprise caps (B) at the 3' and 5' ends of the sense strand or sense region.

In certain embodiments, siNA molecules having formula A comprise caps (B) at the 3'-end of the antisense strand or antisense region.

In various embodiments, siNA molecules having formula A comprise caps (B) at the 3' and 5' ends of the sense strand or sense region and caps (B) at the 3'-end of the antisense strand or antisense region.

In yet other embodiments, siNA molecules having formula A comprise caps (B) only at the 5'-end of the sense (upper) strand of the double-stranded nucleic acid molecule.

In some embodiments, siNA molecules having formula A further comprise one or more phosphorothioate internucleotide linkages between the nucleotides. In certain embodiments, siNA molecules having formula A comprise one or more phosphorothioate internucleotide linkages between the first terminal (N) and the adjacent nucleotide on the 3'end of the sense strand, antisense strand, or both sense strand and antisense strands of the nucleic acid molecule. For example, a double-stranded nucleic acid molecule can comprise X1 and/or X2=2 having overhanging nucleotide positions with a phosphorothioate internucleotide linkage, e.g., (NsN) where "s" indicates phosphorothioate.

In some embodiments, one or more of the nucleotides of siNA molecules having formula A include one or more universal base substitutions.

In some embodiments, one or more of the nucleotides of siNA molecules having formula A include one or more LNA substitutions.

In certain embodiments, siNA molecules having formula A have at position 14 from the 5'-end of the antisense strand a ribonucleotide when the nucleotide at that position 14 is a purine.

In certain embodiments, siNA molecules having formula A have at position 14 from the 5'-end of the antisense strand a ribonucleotide or a 2'-deoxy-2'-fluoro nucleotide when the nucleotide at that position 14 is a purine.

In certain embodiments, siNA molecules having formula A have at position 14 from the 5'-end of the antisense strand is a 2'-deoxy-2'-fluoro nucleotide when the nucleotide at that position 14 is a pyrimidine nucleotide. In particularly preferred embodiments, position 14 from the 5'-end of the antisense strand is a 2'-deoxy-2'-fluoro nucleotide regardless of whether it is a purine or a pyrimidine.

In some embodiments, siNA molecules having formula A comprises (N) nucleotides in the antisense strand (lower strand) that are complementary to nucleotides in a target polynucleotide sequence, which also has complementarity to the N and [N] nucleotides of the antisense (lower) strand.

Any of the above described modifications, or combinations thereof, discussed above as applicable to siNAs of the invention, including those in the references cited, can be applied to any of the embodiments to siNA molecules having formula A.

C. Generation/Synthesis of siNA Molecules

The siNAs of the invention can be obtained using a number of techniques known to those of skill in the art. For example the siNA can be chemically synthesized or may be encoded by plasmid (e.g., transcribed as sequences that automatically fold into duplexes with hairpin loops.). siNA can also be generated by cleavage of longer dsRNA (e.g., dsRNA greater than about 25 nucleotides in length) by the *E coli* RNase II or Dicer. These enzymes process the dsRNA into biologically active siNA (see, e.g., Yang et al., PNAS USA 99:9942-9947 (2002); Calegari et al. *PNAS USA* 99:14236 (2002) Byron et al. Ambion Tech Notes; 10 (1):4-6 (2009); Kawaski et al., *Nucleic Acids Res.*, 31:981-987 (2003), Knight and Bass, *Science,* 293:2269-2271 (2001) and Roberston et al., *J. Biol. Chem* 243:82(1969).

1. Chemical Synthesis

Preferably, siNA of the invention are chemically synthesized. Oligonucleotides (e.g., certain modified oligonucleotides or portions of oligonucleotides lacking ribonucleotides) are synthesized using protocols known in the art, for example as described in Caruthers et al., 1992, *Methods in Enzymology* 211, 3-19, Thompson et al., International PCT Publication No. WO 99/54459, Wincott et al., 1995, Nucleic Acids Res. 23, 2677-2684, Wincott et al., 1997, *Methods Mol. Bio.*, 74, 59, Brennan et al., 1998, *Biotechnol Bioeng.*, 61, 33-45, and Brennan, U.S. Pat. No. 6,001,311. The synthesis of oligonucleotides makes use of common nucleic acid protecting and coupling groups, such as dimethoxytrityl at the 5'-end, and phosphoramidites at the 3'-end.

siNA molecules without modifications are synthesized using procedures as described in Usman et al., 1987, *J. Am. Chem. Soc.*, 109, 7845; Scaringe et al., 1990, *Nucleic Acids Res.*, 18, 5433. These syntheses makes use of common nucleic acid protecting and coupling groups, such as dimethoxytrityl at the 5'-end, and phosphoramidites at the 3'-end that can be used for certain siNA molecules of the invention.

In certain embodiments, the siNA molecules of the invention are synthesized, deprotected, and analyzed according to methods described in U.S. Pat. Nos. 6,995,259, 6,686,463, 6,673,918, 6,649,751, 6,989,442, and U.S. patent application Ser. No. 10/190,359.

In a non-limiting synthesis example, small scale syntheses are conducted on a 394 Applied Biosystems, Inc. synthesizer using a 0.2 µmol scale protocol with a 2.5 min coupling step for 2'-O-methylated nucleotides and a 45 second coupling step for 2'-deoxy nucleotides or 2'-deoxy-2'-fluoro nucleotides. Table 9 outlines the amounts and the contact times of the reagents used in the synthesis cycle.

Alternatively, the siNA molecules of the present invention can be synthesized separately and joined together post-synthetically, for example, by ligation (Moore et al., 1992, *Science* 256, 9923; Draper et al., International PCT Publication No. WO 93/23569; Shabarova et al., 1991, *Nucleic Acids Research* 19, 4247; Bellon et al., 1997, *Nucleosides & Nucleotides,* 16, 951; Bellon et al., 1997, *Bioconjugate Chem.* 8, 204), or by hybridization following synthesis and/or deprotection.

Various siNA molecules of the invention can also be synthesized using the teachings of Scaringe et al., U.S. Pat. Nos. 5,889,136; 6,008,400; and 6,111,086.

D. Carrier/Delivery Systems

The siNA molecules of the invention are added directly, or can be complexed with cationic lipids, packaged within liposomes, or as a recombinant plasmid or viral vectors which express the siNA molecules, or conjugated with a delivery vehicle, or otherwise delivered to target cells or tissues. Methods for the delivery of nucleic acid molecules are described in Akhtar et al., 1992, *Trends Cell Bio.*, 2, 139; *Delivery Strategies for Antisense Oligonucleotide Therapeutics*, ed. Akhtar, 1995, Maurer et al., 1999, *Mol. Membr. Biol.*, 16, 129-140; Hofland and Huang, 1999, *Handb. Exp. Pharmacol.*, 137, 165-192; and Lee et al., 2000, *ACS Symp. Ser.*, 752, 184-192. Beigelman et al., U.S. Pat. No. 6,395,713 and Sullivan et al., PCT WO 94/02595 further describe the general methods for delivery of nucleic acid molecules. These protocols can be utilized for the delivery of virtually any nucleic acid molecule. Nucleic acid molecules can be administered to cells by a variety of methods known to those of skill in the art, including, but not restricted to, encapsulation in liposomes, by iontophoresis, or by incorporation into other vehicles, such as biodegradable polymers, hydrogels, cyclodextrins (see for example, Gonzalez et al., 1999, *Bioconjugate Chem.*, 10, 1068-1074; Wang et al., International PCT Publication Nos. WO 03/47518 and WO 03/46185), poly(lactic-co-glycolic)acid (PLGA) and PLCA microspheres (see for example U.S. Pat. No. 6,447,796 and US Patent Application Publication No. US 2002130430), biodegradable nanocapsules, and bioadhesive microspheres, or by proteinaceous vectors (O'Hare and Normand, International PCT Publication No. WO 00/53722).

In one aspect, the present invention provides carrier systems containing the siNA molecules described herein. In some embodiments, the carrier system is a lipid-based carrier system, cationic lipid, or liposome nucleic acid complexes, a liposome, a micelle, a virosome, a lipid nanoparticle or a mixture thereof. In other embodiments, the carrier system is a polymer-based carrier system such as a cationic polymer-nucleic acid complex. In additional embodiments, the carrier system is a cyclodextrin-based carrier system such as a cyclodextrin polymer-nucleic acid complex. In further embodiments, the carrier system is a protein-based carrier system such as a cationic peptide-nucleic acid complex. Preferably, the carrier system is a lipid nanoparticle ("LNP") formulation.

In certain embodiments, the siNA molecules of the invention are formulated with a lipid nanoparticle composition such as is described in U.S. patent application Ser. Nos. 11/353,630, 11/586,102, 61/189,295, 61/204,878, 61/235,476, 61/249,807, 61/298,022, 61/351,373, 61/347,640, 61/345,754, 61/322,054, 12/640,342, and 12/617,079, and PCT Applications Nos. PCT/US10/020013 and PCT/US09/053336. In certain preferred embodiments, the siNA molecules of the invention are formulated with a lipid nanoparticle composition comprising a cationic lipid/Cholesterol/PEG-C-DMA/DSPC in a 40/48/2/10 a cationic lipid/Cholesterol/PEG-DMG/DSPC in a 40/48/2/10 ratio. In more certain embodiments, the cationic lipid is DLinDMA, the PEG is PEG-DMG, and the N/P ratio of the formulation is 2.8. In more preferred embodiments, the cationic lipid is CLinDMA (see U.S. Pat. No. 7,514,099)

In various embodiments, lipid nanoparticle formulations described in any of the cited applications referred to herein are applied to any siNA molecule or combination of siNA molecules herein. In some embodiments, the invention features a composition comprising an siNA molecule of the invention formulated as any of formulation LNP-051; LNP-053; LNP-054; LNP-069; LNP-073; LNP-077; LNP-080; LNP-082; LNP-083; LNP-060; LNP-061; LNP-086; LNP-097; LNP-098; LNP-099; LNP-100; LNP-101; LNP-102; LNP-103; or LNP-104.

In certain other embodiments, the invention features a composition comprising an siNA molecule of the invention formulated with any of the cationic lipid formulations described in U.S. Patent Application Nos. 61/189,295, 61/204,878, 61/235,476, 61/249,807, 61/298,022, 61/322,054, 61/347,640, 61/351,373, 61/382,067, 61/384,486, and 61/388,201.

In other embodiments, the invention features conjugates and/or complexes of siNA molecules of the invention. Such conjugates and/or complexes include ligand based and polymer based delivery modalities that can be used to facilitate delivery of siNA molecules into a biological system, such as a cell. The conjugates and complexes provided by the instant invention can impart therapeutic activity by transferring therapeutic compounds across cellular membranes, altering the pharmacokinetics, and/or modulating the localization of nucleic acid molecules of the invention. Non-limiting, examples of such conjugates are described in U.S. Publication Nos. US2008/0152661 A1 and US 2004/0162260 A1 (e.g., CDM-LBA, CDM-Pip-LBA, CDM-PEG, CDM-NAG, etc.) and U.S. patents application Ser. Nos. 10/427,160 10/201,394, 61/322,422, 61/378,609, and 61/315,223; and U.S. Pat. Nos. 6,528,631; 6,335,434; 6,235,886; 6,153,737; 5,214,136; and 5,138,045.

In various embodiments, polyethylene glycol (PEG) can be covalently attached to siNA compounds of the present invention. The attached PEG can be any molecular weight, preferably from about 100 to about 50,000 daltons (Da).

In yet other embodiments, the invention features compositions or formulations comprising surface-modified liposomes containing poly (ethylene glycol) lipids (PEG-modified, or long-circulating liposomes or stealth liposomes) and siNA molecules of the invention, such as is disclosed in for example, International PCT Publication No. WO 96/10391; Ansell et al., International PCT Publication No. WO 96/10390; Holland et al., International PCT Publication No. WO 96/10392.

In some embodiments, the siNA molecules of the invention can also be formulated or complexed with polyethyleneimine and derivatives thereof, such as polyethyleneimine-polyethyleneglycol-N-acetylgalactosamine (PEI-PEG-GAL) or polyethyleneimine-polyethyleneglycol-tri-N-acetylgalactosamine (PEI-PEG-triGAL) derivatives. In one embodiment, the nucleic acid molecules of the invention are formulated as described in U.S. Patent Application Publication No. 20030077829.

In other embodiments, siNA molecules of the invention are complexed with membrane disruptive agents such as those described in U.S. Patent Application Publication No. 20010007666. In still other embodiments, the membrane disruptive agent or agents and the siNA molecule are also complexed with a cationic lipid or helper lipid molecule, such as those lipids described in U.S. Pat. No. 6,235,310.

In certain embodiments, siNA molecules of the invention are complexed with delivery systems as described in U.S. Patent Application Publication Nos. 2003077829; 20050287551; 20050164220; 20050191627; 20050118594; 20050153919; 20050085486; and 20030158133; and International PCT Publication Nos. WO 00/03683 and WO 02/087541.

In some embodiments, a liposomal formulation of the invention comprises an siNA molecule of the invention (e.g., siNA) formulated or complexed with compounds and compositions described in U.S. Pat. Nos. 6,858,224; 6,534,484; 6,287,591; 6,835,395; 6,586,410; 6,858,225; 6,815,432; 6,586,001; 6,120,798; 6,977,223; 6,998,115; 5,981,501; 5,976,567; 5,705,385; and U.S. Patent Application Publication Nos. 2006/0019912; 2006/0019258; 2006/0008909; 2005/0255153; 2005/0079212; 2005/0008689; 2003/0077829, 2005/0064595, 2005/0175682, 2005/0118253; 2004/0071654; 2005/0244504; 2005/0265961 and 2003/0077829.

Alternatively, recombinant plasmids and viral vectors, as discussed above, which express siNAs of the invention can be used to deliver the molecules of the invention. Delivery of siNA molecule expressing vectors can be systemic, such as by intravenous or intra-muscular administration, by administration to target cells ex-planted from a subject followed by reintroduction into the subject, or by any other means that would allow for introduction into the desired target cell (for a review see Couture et al., 1996, TIG., 12, 510). Such recombinant plasmids can also be administered directly or in conjunction with a suitable delivery reagents, including, for example, the Mirus Transit LT1 lipophilic reagent; lipofectin; lipofectamine; cellfectin; polycations (e.g., polylysine) or liposomes lipid-based carrier system, cationic lipid, or liposome nucleic acid complexes, a micelle, a virosome, a lipid nanoparticle.

E. Kits

The present invention also provides nucleic acids in kit form. The kit may comprise a container. The kit typically contains a nucleic acid of the invention with instructions for its administration. In certain instances, the nucleic acids may have a targeting moiety or delivery agent attached. Methods of attaching targeting moieties (e.g. antibodies, proteins) or delivery agents (conjugates) are known to those of skill in the art. In certain instances, the kit contains more than one siNA molecule of the invention. The kits may comprise an siNA molecule of the invention with a pharmaceutically acceptable carrier or diluent. The kits may further comprise excipients.

F. Therapeutic Uses/Pharmaceutical Compositions

The nucleic acid molecules and pharmaceutical compositions of the invention can be used to treat diseases, conditions, or phenotypes related to gene expression. Non-limiting examples of such diseases, conditions, and phenotypes are described herein and are otherwise known in the art 1. Indications Particular conditions and disease states that can be associated with gene expression modulation include, but are not limited to cancer, proliferative, inflammatory, autoimmune, neurologic, ocular, respiratory, metabolic, dermatological, auditory, liver, kidney, infectious etc. diseases, conditions, or disorders as described herein or otherwise known in the art, and any other diseases, conditions or disorders that are related to or will respond to the levels of a target (e.g., target DNA, RNA, protein or polynucleotide) in a cell or tissue, alone or in combination with other therapies.

Proliferative diseases (cancer) include any disease or condition characterized by unregulated cell growth or replication as is known in the art; including leukemias, for example, acute myelogenous leukemia (AML), chronic myelogenous leukemia (CML), acute lymphocytic leukemia (ALL), and chronic lymphocytic leukemia, AIDS related cancers such as Kaposi's sarcoma; breast cancers; bone cancers such as Osteosarcoma, Chondrosarcomas, Ewing's sarcoma, Fibrosarcomas, Giant cell tumors, Adamantinomas, and Chordomas; Brain cancers such as Meningiomas, Glioblastomas, Lower-Grade Astrocytomas, Oligodendrocytomas, Pituitary Tumors, Schwannomas, and Metastatic brain cancers; cancers of the head and neck including various lymphomas such as mantle cell lymphoma, non-Hodgkins lymphoma, adenoma, squamous cell carcinoma, laryngeal carcinoma, gallbladder and bile duct cancers, cancers of the retina such as retinoblastoma, cancers of the esophagus, gastric cancers, multiple myeloma, ovarian cancer, uterine cancer, thyroid cancer, testicular cancer, endometrial cancer, melanoma, colorectal cancer, lung cancer, bladder cancer, prostate cancer, lung cancer (including non-small cell lung carcinoma), pancreatic cancer, sarcomas, Wilms' tumor, cervical cancer, head and neck cancer, skin cancers, nasopharyngeal carcinoma, liposarcoma, epithelial carcinoma, renal cell carcinoma, gallbladder adeno carcinoma, parotid adenocarcinoma, endometrial sarcoma, multidrug resistant cancers; and proliferative diseases and conditions, such as neovascularization associated with tumor angiogenesis, macular degeneration (e.g., wet/dry AMD), corneal neovascularization, diabetic retinopathy, neovascular glaucoma, myopic degeneration and other proliferative diseases and conditions such as restenosis and polycystic kidney disease, and any other cancer or proliferative disease, condition, trait, genotype or phenotype that can respond to the modulation of disease related gene expression in a cell or tissue, alone or in combination with other therapies.

Inflammatory diseases include any disease or condition characterized by an inflammatory or allergic process as is known in the art, such as inflammation, acute inflammation, chronic inflammation, respiratory disease, atherosclerosis, psoriasis, dermatitis, restenosis, asthma, allergic rhinitis, atopic dermatitis, septic shock, rheumatoid arthritis, inflammatory bowl disease, inflammatory pelvic disease, pain, ocular inflammatory disease, celiac disease, Leigh Syndrome, Glycerol Kinase Deficiency, Familial eosinophilia (FE), autosomal recessive spastic ataxia, laryngeal inflammatory disease; Tuberculosis, Chronic cholecystitis, Bronchiectasis, Silicosis and other pneumoconioses, and any other inflammatory disease, condition, trait, genotype or phenotype that can respond to the modulation of disease related gene expression in a cell or tissue, alone or in combination with other therapies.

Autoimmune diseases include any disease or condition characterized by autoimmunity as is known in the art, such as multiple sclerosis, diabetes mellitus, lupus, celiac disease, Crohn's disease, ulcerative colitis, Guillain-Barre syndrome, scleroderms, Goodpasture's syndrome, Wegener's granulomatosis, autoimmune epilepsy, Rasmussen's encephalitis, Primary biliary sclerosis, Sclerosing cholangitis, Autoimmune hepatitis, Addison's disease, Hashimoto's thyroiditis, Fibromyalgia, Menier's syndrome; transplantation rejection (e.g., prevention of allograft rejection) pernicious anemia, rheumatoid arthritis, systemic lupus erythematosus, dermatomyositis, Sjogren's syndrome, lupus erythematosus, multiple sclerosis, myasthenia gravis, Reiter's syndrome, Grave's disease, and any other autoimmune disease, condition, trait, genotype or phenotype that can respond to the modulation of disease related gene expression in a cell or tissue, alone or in combination with other therapies.

Infectious diseases include any disease or condition associated with an infectious agent, such as a virus, bacteria, fungus, prion, or parasite. Non-limiting examples of various viral genes that can be targeted using siNA molecules of the invention include Hepatitis C Virus (HCV, for example GenBank Accession Nos: D11168, D50483.1, L38318 and S82227), Hepatitis B Virus (HBV, for example GenBank Accession No. AF100308.1), Human Immunodeficiency Virus type 1 (HIV-1, for example GenBank Accession No. U51188), Human Immunodeficiency Virus type 2 (HIV-2, for example GenBank Accession No. X60667), West Nile Virus (WNV for example GenBank accession No. NC_001563), cytomegalovirus (CMV for example GenBank Accession No. NC_001347), respiratory syncytial virus (RSV for example GenBank Accession No. NC_001781), influenza virus (for example GenBank Accession No. AF037412, rhinovirus (for example, GenBank accession numbers: D00239, X02316, X01087, L24917, M16248, K02121, X01087), papillomavirus (for example GenBank Accession No. NC_001353), Herpes Simplex Virus (HSV for example GenBank Accession No. NC_001345), and other viruses such as HTLV (for example GenBank Accession No. AJ430458). Due to the high sequence variability of many viral genomes, selection of siNA molecules for broad therapeutic applications would likely involve the conserved regions of the viral genome. Nonlimiting examples of conserved regions of the viral genomes include but are not limited to 5'-Non Coding Regions (NCR), 3'-Non Coding Regions (NCR) and/or internal ribosome entry sites (IRES). siNA molecules designed against conserved regions of various viral genomes will enable efficient inhibition of viral replication in diverse patient populations and may ensure the effectiveness of the siNA molecules against viral quasi species which evolve due to mutations in the non-conserved regions of the viral genome. Non-limiting examples of bacterial infections include Actinomycosis, Anthrax, Aspergillosis, Bacteremia, Bacterial Infections and Mycoses, Bartonella Infections, Botulism, Brucellosis, Burkholderia Infections, Campylobacter Infections, Candidiasis, Cat-Scratch Disease, Chlamydia Infections, Cholera, Clostridium Infections, Coccidioidomycosis, Cross Infection, Cryptococcosis, Dermatomycoses, Dermatomycoses, Diphtheria, Ehrlichiosis, Escherichia coli Infections, Fasciitis, Necrotizing, Fusobacterium Infections, Gas Gangrene, Gram-Negative Bacterial Infections, Gram-Positive Bacterial Infections, Histoplasmosis, Impetigo, *Klebsiella* Infections, Legionellosis, Leprosy, Leptospirosis, *Listeria* Infections, Lyme Disease, Maduromycosis, Melioidosis, *Mycobacterium* Infections, *Mycoplasma* Infections, Mycoses, *Nocardia* Infections, Onychomycosis, Ornithosis, Plague, Pneumococcal Infections, *Pseudomonas* Infections, Q Fever, Rat-Bite Fever, Relapsing Fever, Rheumatic Fever, *Rickettsia* Infections, Rocky Mountain Spotted Fever, *Salmonella* Infections, Scarlet Fever, Scrub Typhus, Sepsis, Sexually Transmitted Diseases-Bacterial, Bacterial Skin Diseases, Staphylococcal Infections, Streptococcal Infections, Tetanus, Tick-Borne Diseases, Tuberculosis, Tularemia, Typhoid Fever, Typhus, Epidemic Louse-Borne, *Vibrio* Infections, Yaws, *Yersinia* Infections, Zoonoses, and Zygomycosis. Non-limiting examples of fungal infections include Aspergillosis, Blastomycosis, Coccidioidomycosis, Cryptococcosis, Fungal Infections of Fingernails and Toenails, Fungal Sinusitis, Histoplasmosis, Histoplasmosis, Mucormycosis, Nail Fungal Infection, Paracoccidioidomycosis, Sporotrichosis, Valley Fever (Coccidioidomycosis), and Mold Allergy.

Neurologic diseases include any disease or condition affecting the central or peripheral nervous system, including ADHD, AIDS-Neurological Complications, Absence of the Septum Pellucidum, Acquired Epileptiform Aphasia, Acute Disseminated Encephalomyelitis, Adrenoleukodystrophy, Agenesis of the Corpus Callosum, Agnosia, Aicardi Syndrome, Alexander Disease, Alpers' Disease, Alternating Hemiplegia, Alzheimer's Disease, Amyotrophic Lateral Sclerosis, Anencephaly, Aneurysm, Angelman Syndrome, Angiomatosis, Anoxia, Aphasia, Apraxia, Arachnoid Cysts, Arachnoiditis, Arnold-Chiari Malformation, Arteriovenous Malformation, Aspartame, Asperger Syndrome, Ataxia Telangiectasia, Ataxia, Attention Deficit-Hyperactivity Disorder, Autism, Autonomic Dysfunction, Back Pain, Barth Syndrome, Batten Disease, Behcet's Disease, Bell's Palsy, Benign Essential Blepharospasm, Benign Focal Amyotrophy, Benign Intracranial Hypertension, Bernhardt-Roth Syndrome, Binswanger's Disease, Blepharospasm, Bloch-Sulzberger Syndrome, Brachial Plexus Birth Injuries, Brachial Plexus Injuries, Bradbury-Eggleston Syndrome, Brain Aneurysm, Brain Injury, Brain and Spinal Tumors, Brown-Sequard Syndrome, Bulbospinal Muscular Atrophy, Canavan Disease, Carpal Tunnel Syndrome, Causalgia, Cavernomas, Cavernous Angioma, Cavernous Malformation, Central Cervical Cord Syndrome, Central Cord Syndrome, Central Pain Syndrome, Cephalic Disorders, Cerebellar Degeneration, Cerebellar Hypoplasia, Cerebral Aneurysm, Cerebral Arteriosclerosis, Cerebral Atrophy, Cerebral Beriberi, Cerebral Gigantism, Cerebral Hypoxia, Cerebral Palsy, Cerebro-Oculo-Facio-Skeletal Syndrome, Charcot-Marie-Tooth Disorder, Chiari Malformation, Chorea, Choreoacanthocytosis, Chronic Inflammatory Demyelinating Polyneuropathy (CIDP), Chronic Orthostatic Intolerance, Chronic Pain, Cockayne Syndrome Type II, Coffin Lowry Syndrome, Coma, including Persistent Vegetative State, Complex Regional Pain Syndrome, Congenital Facial Diplegia, Congenital Myasthenia, Congenital Myopathy, Congenital Vascular Cavernous Malformations, Corticobasal Degeneration, Cranial Arteritis, Craniosynostosis, Creutzfeldt-Jakob Disease, Cumulative Trauma Disorders, Cushing's Syndrome, Cytomegalic Inclusion Body Disease (CIBD), Cytomegalovirus Infection, Dancing Eyes-Dancing Feet Syndrome, Dandy-Walker Syndrome, Dawson Disease, De Morsier's Syndrome, Dejerine-Klumpke Palsy, Dementia-Multi-Infarct, Dementia-Subcortical, Dementia With Lewy Bodies, Dermatomyositis, Developmental Dyspraxia, Devic's Syndrome, Diabetic Neuropathy, Diffuse Sclerosis, Dravet's Syndrome, Dysautonomia, Dysgraphia, Dyslexia, Dysphagia, Dyspraxia, Dystonias, Early Infantile Epileptic Encephalopathy, Empty Sella Syndrome, Encephalitis Lethargica, Encephalitis and Meningitis, Encephaloceles, Encephalopathy, Encephalotrigeminal Angiomatosis, Epilepsy, Erb's Palsy, Erb-Duchenne and Dejerine-Klumpke Palsies, Fabry's Disease, Fahr's Syndrome, Fainting, Familial Dysautonomia, Familial Hemangioma, Familial Idiopathic Basal Ganglia Calcification, Familial Spastic Paralysis, Febrile Seizures (e.g., GEFS and GEFS plus), Fisher Syndrome, Floppy Infant Syndrome, Friedreich's Ataxia, Gaucher's Disease, Gerstmann's Syndrome, Gerstmann-Straussler-Scheinker Disease, Giant Cell Arteritis, Giant Cell Inclusion Disease, Globoid Cell Leukodystrophy, Glossopharyngeal Neuralgia, Guillain-Barre Syndrome, HTLV-1 Associated Myelopathy, Hallervorden-Spatz Disease, Head Injury, Headache, Hemicrania Continua, Hemifacial Spasm, Hemiplegia Alterans, Hereditary Neuropathies, Hereditary Spastic Paraplegia, Heredopathia Atactica Polyneuritiformis, Herpes Zoster Oticus, Herpes Zoster, Hirayama Syndrome, Holoprosencephaly, Huntington's Disease, Hydranencephaly, Hydrocephalus-Normal Pressure, Hydrocephalus, Hydromyelia, Hypercortisolism, Hypersomnia, Hypertonia, Hypotonia, Hypoxia, Immune-Mediated Encephalomyelitis, Inclusion Body Myositis, Incontinentia Pigmenti, Infantile Hypotonia, Infantile Phytanic Acid Storage Disease, Infantile Refsum Disease, Infantile Spasms, Inflammatory Myopathy, Intestinal Lipodystrophy, Intracranial Cysts, Intracranial Hypertension, Isaac's Syndrome, Joubert Syndrome, Kearns-Sayre Syndrome, Kennedy's Disease, Kinsbourne syndrome, Kleine-Levin syndrome, Klippel Feil Syndrome, Klippel-Trenaunay Syndrome (KTS), Klüver-Bucy Syndrome, Korsakoff's Amnesic Syndrome, Krabbe Disease, Kugelberg-Welander Disease, Kuru, Lambert-Eaton Myasthenic Syndrome, Landau-Kleffner Syndrome, Lateral Femoral Cutaneous Nerve Entrapment, Lateral Medullary Syndrome, Learning Disabilities, Leigh's Disease, Lennox-Gastaut Syndrome, Lesch-Nyhan Syndrome, Leukodystrophy, Levine-Critchley Syndrome, Lewy Body Dementia, Lissencephaly, Locked-In Syndrome, Lou Gehrig's Disease, Lupus-Neurological Sequelae, Lyme Disease-Neurological Complications, Machado-Joseph Disease, Macrencephaly, Megalencephaly, Melkersson-Rosenthal Syndrome, Meningitis, Menkes Disease, Meralgia Paresthetica, Metachromatic Leukodystrophy, Microcephaly, Migraine, Miller Fisher Syndrome, Mini-Strokes, Mitochondrial Myopathies, Mobius Syndrome, Monomelic Amyotrophy, Motor Neuron Diseases, Moyamoya Disease, Mucolipidoses, Mucopolysaccharidoses, Multi-Infarct Dementia, Multifocal Motor Neuropathy, Multiple Sclerosis, Multiple System Atrophy with Orthostatic Hypotension, Multiple System Atrophy, Muscular Dystrophy, Myasthenia-Congenital, Myasthenia Gravis, Myelinoclastic Diffuse Sclerosis, Myoclonic Encephalopathy of Infants, Myoclonus, Myopathy-Congenital, Myopathy-Thyrotoxic, Myopathy, Myotonia Congenita, Myotonia, Narcolepsy, Neuroacanthocytosis, Neurodegeneration with Brain Iron Accumulation, Neurofibromatosis, Neuroleptic Malignant Syndrome, Neurological Complications of AIDS, Neurological Manifestations of Pompe Disease, Neuromyelitis Optica, Neuromyotonia, Neuronal Ceroid Lipofuscinosis, Neuronal Migration Disorders, Neuropathy-Hereditary, Neurosarcoidosis, Neurotoxicity, Nevus Cavernosus, Niemann-Pick Disease, O'Sullivan-McLeod Syndrome, Occipital Neuralgia, Occult Spinal Dysraphism Sequence, Ohtahara Syndrome, Olivopontocerebellar Atrophy, Opsoclonus Myoclonus, Orthostatic Hypotension, Overuse Syndrome, Pain-Chronic, Paraneoplastic Syndromes, Paresthesia, Parkinson's Disease, Parmyotonia Congenita, Paroxysmal Choreoathetosis, Paroxysmal Hemicrania, Parry-Romberg, Pelizaeus-Merzbacher Disease, Pena Shokeir II Syndrome, Perineural Cysts, Periodic Paralyses, Peripheral Neuropathy, Periventricular Leukomalacia, Persistent Vegetative State, Pervasive Developmental Disorders, Phytanic Acid Storage Disease, Pick's Disease, Piriformis Syndrome, Pituitary Tumors, Polymyositis, Pompe Disease, Porencephaly, Post-Polio Syndrome, Postherpetic Neuralgia, Postinfectious Encephalomyelitis, Postural Hypotension, Postural Orthostatic Tachycardia Syndrome, Postural Tachycardia Syndrome, Primary Lateral Sclerosis, Prion Diseases, Progressive Hemifacial Atrophy, Progressive Locomotor Ataxia, Progressive Multifocal Leukoencephalopathy, Progressive Sclerosing Poliodystrophy, Progressive Supranuclear Palsy, Pseudotumor Cerebri, Pyridoxine Dependent and Pyridoxine Responsive Siezure Disorders, Ramsay Hunt Syndrome Type I, Ramsay Hunt Syndrome Type II, Rasmussen's Encephalitis and other autoimmune epilepsies, Reflex Sympathetic Dystrophy Syndrome, Refsum Disease-Infantile, Refsum Disease, Repetitive Motion Disorders, Repetitive Stress Injuries, Restless Legs Syndrome, Retrovirus-Associated Myelopathy, Rett Syndrome, Reye's Syndrome, Riley-Day Syndrome, SUNCT Headache, Sacral Nerve Root Cysts, Saint Vitus Dance, Salivary Gland Disease, Sandhoff Disease, Schilder's Disease, Schizencephaly, Seizure Disorders, Septo-Optic Dysplasia, Severe Myoclonic Epilepsy of Infancy (SMEI), Shaken Baby Syndrome, Shingles, Shy-Drager Syndrome, Sjogren's Syndrome, Sleep Apnea, Sleeping Sickness, Soto's Syndrome, Spasticity, Spina Bifida, Spinal Cord Infarction, Spinal Cord Injury, Spinal Cord Tumors, Spinal Muscular Atrophy, Spinocerebellar Atrophy, Steele-Richardson-Olszewski Syndrome, Stiff-Person Syndrome, Striatonigral Degeneration, Stroke, Sturge-Weber Syndrome, Subacute Sclerosing Panencephalitis, Subcortical Arteriosclerotic Encephalopathy, Swallowing Disorders, Sydenham Chorea, Syncope, Syphilitic Spinal Sclerosis, Syringohydromyelia, Syringomyelia, Systemic Lupus Erythematosus, Tabes Dorsalis, Tardive Dyskinesia, Tarlov Cysts, Tay-Sachs Disease, Temporal Arteritis, Tethered Spinal Cord Syndrome, Thomsen Disease, Thoracic Outlet Syndrome, Thyrotoxic Myopathy, Tic Douloureux, Todd's Paralysis, Tourette Syndrome, Transient Ischemic Attack, Transmissible Spongiform Encephalopathies, Transverse Myelitis, Traumatic Brain Injury, Tremor, Trigeminal Neuralgia, Tropical Spastic Paraparesis, Tuberous Sclerosis, Vascular Erectile Tumor, Vasculitis including Temporal Arteritis, Von Economo's Disease, Von Hippel-Lindau disease (VHL), Von Recklinghausen's Disease, Wallenberg's Syndrome, Werdnig-Hoffman Disease, Wernicke-Korsakoff Syndrome, West Syndrome, Whipple's Disease, Williams Syndrome, Wilson's Disease, X-Linked Spinal and Bulbar Muscular Atrophy, and Zellweger Syndrome.

Respiratory diseases include any disease or condition affecting the respiratory tract, such as asthma, chronic obstructive pulmonary disease or "COPD", allergic rhinitis, sinusitis, pulmonary vasoconstriction, inflammation, allergies, impeded respiration, respiratory distress syndrome, cystic fibrosis, pulmonary hypertension, pulmonary vasoconstriction, emphysema, and any other respiratory disease, condition, trait, genotype or phenotype that can respond to the modulation of disease related gene expression in a cell or tissue, alone or in combination with other therapies.

Ocular diseases include any disease or condition affecting eye and related structures as is known in the art, such as Cystoid Macular Edema, Asteroid Hyalosis, Pathological Myopia and Posterior Staphyloma, Toxocariasis (Ocular Larva Migrans), Retinal Vein Occlusion, Posterior Vitreous Detachment, Tractional Retinal Tears, Epiretinal Membrane, Diabetic Retinopathy, Lattice Degeneration, Retinal Vein Occlusion, Retinal Artery Occlusion, Macular Degeneration (e.g., age related macular degeneration such as wet AMD or dry AMD), Toxoplasmosis, Choroidal Melanoma, Acquired Retinoschisis, Hollenhorst Plaque, Idiopathic Central Serous Chorioretinopathy, Macular Hole, Presumed Ocular Histoplasmosis Syndrome, Retinal Macroaneursym, Retinitis Pigmentosa, Retinal Detachment, Hypertensive Retinopathy, Retinal Pigment Epithelium (RPE) Detachment, Papillophlebitis, Ocular Ischemic Syndrome, Coats' Disease, Leber's Miliary Aneurysm, Conjunctival Neoplasms, Allergic Conjunctivitis, Vernal Conjunctivitis, Acute Bacterial Conjunctivitis, Allergic Conjunctivitis & Vernal Keratoconjunctivitis, Viral Conjunctivitis, Bacterial Conjunctivitis, Chlamydial & Gonococcal Conjunctivitis, Conjunctival Laceration, Episcleritis, Scleritis, Pingueculitis, Pterygium, Superior Limbic Keratoconjunctivitis (SLK of Theodore), Toxic Conjunctivitis, Conjunctivitis with Pseudomembrane, Giant Papillary Conjunctivitis, Terrien's Marginal Degeneration, Acanthamoeba Keratitis, Fungal Keratitis, Filamentary Keratitis, Bacterial Keratitis, Keratitis Sicca/Dry Eye Syndrome, Bacterial Keratitis, Herpes Simplex Keratitis, Sterile Corneal Infiltrates, Phlyctenulosis, Corneal Abrasion & Recurrent Corneal Erosion, Corneal Foreign Body, Chemical Burs, Epithelial Basement Membrane Dystrophy (EBMD), Thygeson's Superficial Punctate Keratopathy, Corneal Laceration, Salzmann's Nodular Degeneration, Fuchs' Endothelial Dystrophy, Crystalline Lens Subluxation, Ciliary-Block Glaucoma, Primary Open-Angle Glaucoma, Pigment Dispersion Syndrome and Pigmentary Glaucoma, Pseudoexfoliation Syndrom and Pseudoexfoliative Glaucoma, Anterior Uveitis, Primary Open Angle Glaucoma, Uveitic Glaucoma & Glaucomatocyclitic Crisis, Pigment Dispersion Syndrome & Pigmentary Glaucoma, Acute Angle Closure Glaucoma, Anterior Uveitis, Hyphema, Angle Recession Glaucoma, Lens Induced Glaucoma, Pseudoexfoliation Syndrome and Pseudoexfoliative Glaucoma, Axenfeld-Rieger Syndrome, Neovascular Glaucoma, Pars Planitis, Choroidal Rupture, Duane's Retraction Syndrome, Toxic/Nutritional Optic Neuropathy, Aberrant Regeneration of Cranial Nerve III, Intracranial Mass Lesions, Carotid-Cavernous Sinus Fistula, Anterior Ischemic Optic Neuropathy, Optic Disc Edema & Papilledema, Cranial Nerve III Palsy, Cranial Nerve IV Palsy, Cranial Nerve VI Palsy, Cranial Nerve VII (Facial Nerve) Palsy, Horner's Syndrome, Internuclear Ophthalmoplegia, Optic Nerve Head Hypoplasia, Optic Pit, Tonic Pupil, Optic Nerve Head Drusen, Demyelinating Optic Neuropathy (Optic Neuritis, Retrobulbar Optic Neuritis), Amaurosis Fugax and Transient Ischemic Attack, Pseudotumor Cerebri, Pituitary Adenoma, Molluscum Contagiosum, Canaliculitis, Verruca and Papilloma, Pediculosis and Pthiriasis, Blepharitis, Hordeolum, Preseptal Cellulitis, Chalazion, Basal Cell Carcinoma, Herpes Zoster Ophthalmicus, Pediculosis & Phthiriasis, Blow-out Fracture, Chronic Epiphora, Dacryocystitis, Herpes Simplex Blepharitis, Orbital Cellulitis, Senile Entropion, and Squamous Cell Carcinoma.

Dermatologic diseases include any disease or condition affecting the skin, dermis, or any substructure therein such as hair, follicle, etc. Dermatological diseases, disorders, conditions, and traits can include psoriasis, ectopic dermatitis, skin cancers such as melanoma and basal cell carcinoma, hair loss, hair removal, alterations in pigmentation, and any other disease, condition, or trait associated with the skin, dermis, or structures therein.

Auditory diseases include any disease or condition affecting the auditory system, including the ear, such as the inner ear, middle ear, outer ear, auditory nerve, and any substructures therein. Auditory diseases, disorders, conditions, and traits can include hearing loss, deafness, tinnitus, Meniere's Disease, vertigo, balance and motion disorders, and any other disease, condition, or trait associated with the ear, or structures therein.

Metabolic diseases include any disease or condition affecting metabolic pathways as in known in the art. Metabolic disease can result in an abnormal metabolic process, either congenital due to inherited enzyme abnormality (inborn errors of metabolism) or acquired due to disease of an endocrine organ or failure of a metabolically important organ such as the liver. In one embodiment, metabolic disease includes hyperlipidemia, hypercholesterolemia, cardiovascular disease, atherosclerosis, hypertension, diabetes (e.g., type I and/or type II diabetes), insulin resistance, and/or obesity.

Cardiovascular diseases include any disease or condition affecting the heart and vasculature, including but not limited to, coronary heart disease (CHD), cerebrovascular disease (CVD), aortic stenosis, peripheral vascular disease, atherosclerosis, arteriosclerosis, myocardial infarction (heart attack), cerebrovascular diseases (stroke), transient ischemic attacks (TIA), angina (stable and unstable), atrial fibrillation, arrhythmia, vavular disease, congestive heart failure, hypercholesterolemia, type I hyperlipoproteinemia, type II hyperlipoproteinemia, type III hyperlipoproteinemia, type IV hyperlipoproteinemia, type V hyperlipoproteinemia, secondary hypertrigliceridemia, and familial lecithin cholesterol acyltransferase deficiency.

It is understood that the siNA molecules of the invention can silence the expression of target genes and thus amenable to the treatment of various diseases and conditions herein or otherwise known in the art. Treatment of a disease can be evaluated by directly measuring the progress of the disease in a subject. It can also be inferred through observing a change or reversal in a condition associated with the disease. Additionally, the siNA molecules of the invention can be used as a prophylaxis. Thus, the use of the nucleic acid molecules and pharmaceutical compositions of the invention can be used to ameliorate, treat, prevent, and/or cure these diseases and others associated with gene expression and/or activity.

Subjects (e.g., mammalian, human) that are amendable for treatment using the siNA molecules of the invention (optionally further substituted or modified or conjugated), compositions thereof, and methods of the present disclosure include those suffering from one or more disease or condition mediated, at least in part, by an aberrant expression level of the target gene or sequence, those at risk of developing a disease caused by or associated with the aberrant levels of a target gene/sequence, or those which are amenable to treatment by replenishing or increasing the level of RNAi mediated by the corresponding siNA molecule, including a hyperproliferative (e.g., cancer), angiogenic, metabolic, or inflammatory (e.g., arthritis) disease or disorder or condition.

Compositions and methods disclosed herein are useful in the treatment of a wide variety of target viruses, including retrovirus, such as human immunodeficiency virus (HIV), Hepatitis C Virus, Hepatitis B Virus, Coronavirus, as well as respiratory viruses, including human Respiratory Syncytial Virus, human Metapneumovirus, human Parainfluenza virus, Rhinovirus and Influenza virus.

In other examples, the compositions and methods of this disclosure are useful as therapeutic tools to treat or prevent symptoms of, for example, hyperproliferative disorders. Exemplary hyperproliferative disorders include neoplasms, carcinomas, sarcomas, tumors, or cancer. More exemplary hyperproliferative disorders include oral cancer, throat cancer, laryngeal cancer, esophageal cancer, pharyngeal cancer, nasopharyngeal cancer, oropharyngeal cancer, gastrointestinal tract cancer, gastrointestinal stromal tumors (GIST), small intestine cancer, colon cancer, rectal cancer, colorectal cancer, anal cancer, pancreatic cancer, breast cancer, cervical cancer, uterine cancer, vulvar cancer, vaginal cancer, urinary tract cancer, bladder cancer, kidney cancer, adrenocortical cancer, islet cell carcinoma, gallbladder cancer, stomach cancer, prostate cancer, ovarian cancer, endometrial cancer, trophoblastic tumor, testicular cancer, penial cancer, bone cancer, osteosarcoma, liver cancer, extrahepatic bile duct cancer, skin cancer, basal cell carcinoma (BCC), lung cancer, small cell lung cancer, non-small cell lung cancer (NSCLC), brain cancer, melanoma, Kaposi's sarcoma, eye cancer, head and neck cancer, squamous cell carcinoma of head and neck, tymoma, thymic carcinoma, thyroid cancer, parathyroid cancer, Hippel-Lindau syndrome, leukemia, acute myeloid leukemia, chronic myelogenous leukemia, acute lymphoblastic leukemia, hairy cell leukemia, lymphoma, non-Hodgkin's lymphoma, Burkitt's lymphoma, T-cell lymphoma, multiple myeloma, malignant pleural mesothelioma, Barrett's adenocarcinoma, Wilm's tumor, or the like. In other examples, the compositions and methods of this disclosure are useful as therapeutic tools to regulate expression of one or more target gene to treat or prevent symptoms of, for example, inflammatory disorders. Exemplary inflammatory disorders include diabetes mellitus, rheumatoid arthritis, pannus growth in inflamed synovial lining, collagen-induced arthritis, spondylarthrites, ankylosing spondylitis, multiple sclerosis, encephalomyelitis, inflammatory bowel disease, Crohn's disease, psoriasis or psoriatic arthritis, myasthenia gravis, systemic lupus erythematosis, graft-versus-host disease, atherosclerosis, and allergies.

Other exemplary disorders that can be treated with the siNA molecules, compositions and methods of the instant disclosure include metabolic disorders, cardiac disease, pulmonary disease, neovascularization, ischemic disorders, age-related macular degeneration, diabetic retinopathy, glomerulonephritis, diabetes, asthma, chronic obstructive pulmonary disease, chronic bronchitis, lymphangiogenesis, and atherosclerosis.

2. Pharmaceutical Compositions

The siNA molecules of the instant invention provide useful reagents and methods for a variety of therapeutic, prophylactic, cosmetic, veterinary, diagnostic, target validation, genomic discovery, genetic engineering, and pharmacogenomic applications.

a. Formulations

Thus, the present invention, in one aspect, also provides for pharmaceutical compositions of the siNA molecules of the invention, i.e., compositions in a pharmaceutically acceptable carrier or diluent. These pharmaceutical compositions include salts, esters, or salts of such esters, of the above compounds, e.g., acid addition salts, for example, salts of hydrochloric, hydrobromic, hydroiodic, acetic acid, and benzene sulfonic acid. Other salts include for example, sodium, potassium, manganese, ammonium, and calcium salts. These formulations or compositions can comprise a pharmaceutically acceptable carrier or diluent as is generally known in the art. The pharmaceutical compositions of the present disclosure are formulated to all the siNA molecule(s) described herein to be bioavailable upon administration to a subject.

In one embodiment, the invention features a pharmaceutical composition comprising any siNA comprising formula (A) as described herein.

The siNA molecules of the invention are preferably formulated as pharmaceutical compositions prior to administering to a subject, according to techniques known in the art. Pharmaceutical compositions of the present invention are characterized as being at least sterile and pyrogen-free. Methods for preparing pharmaceutical compositions of the invention are within the skill in the art for example as described in *Remington's Pharmaceutical Science*, $21^{st}$ ed., Mack Publishing Company, Easton, Pa., A. R. Gennaro edit., 2005.

In some embodiments, pharmaceutical compositions of the invention (e.g. siNA(s) and/or LNP formulations or conjugates or other delivery formulations thereof) further comprise conventional pharmaceutical excipients and/or additives. Suitable pharmaceutical excipients include preservatives, flavoring agents, stabilizers, antioxidants, osmolality adjusting agents, buffers, and pH adjusting agents. Suitable additives include physiologically biocompatible buffers (e.g., trimethylamine hydrochloride), addition of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). In addition, antioxidants and suspending agents can be used.

Non-limiting examples of various types of formulations for local administration include ointments, lotions, creams, gels, foams, preparations for delivery by transdermal patches, powders, sprays, aerosols, capsules or cartridges for use in an inhaler or insufflator or drops (for example eye or nose drops), solutions/suspensions for nebulization, suppositories, pessaries, retention enemas and chewable or suckable tablets or pellets (for example for the treatment of aphthous ulcers) or liposome or microencapsulation preparations.

Ointments, creams and gels, can, for example, can be formulated with an aqueous or oily base with the addition of suitable thickening and/or gelling agent and/or solvents. Non limiting examples of such bases can thus, for example, include water and/or an oil such as liquid paraffin or a vegetable oil such as arachis oil or castor oil, or a solvent such as polyethylene glycol. Various thickening agents and gelling agents can be used depending on the nature of the base. Non-limiting examples of such agents include soft paraffin, aluminum stearate, cetostearyl alcohol, polyethylene glycols, woolfat, beeswax, carboxypolymethylene and cellulose derivatives, and/or glyceryl monostearate and/or non-ionic emulsifying agents.

In one embodiment lotions can be formulated with an aqueous or oily base and will in general also contain one or more emulsifying agents, stabilizing agents, dispersing agents, suspending agents or thickening agents.

In one embodiment powders for external application can be formed with the aid of any suitable powder base, for example, talc, lactose or starch. Drops can be formulated with an aqueous or non-aqueous base also comprising one or more dispersing agents, solubilizing agents, suspending agents or preservatives.

Compositions intended for oral use can be prepared according to any method known to the art for the manufacture of pharmaceutical compositions and such compositions can contain one or more such sweetening agents, flavoring agents, coloring agents or preservative agents in order to provide pharmaceutically elegant and palatable preparations. Tablets contain the active ingredient in admixture with non-toxic pharmaceutically acceptable excipients that are suitable for the manufacture of tablets. These excipients can be, for example, inert diluents; such as calcium carbonate, sodium carbonate, lactose, calcium phosphate or sodium phosphate; granulating and disintegrating agents, for example, corn starch, or alginic acid; binding agents, for example starch, gelatin or acacia; and lubricating agents, for example magnesium stearate, stearic acid or talc. The tablets can be uncoated or they can be coated by known techniques. In some cases such coatings can be prepared by known techniques to delay disintegration and absorption in the gastrointestinal tract and thereby provide a sustained action over a longer period. For example, a time delay material such as glyceryl monosterate or glyceryl distearate can be employed.

Formulations for oral use can also be presented as hard gelatin capsules wherein the active ingredient is mixed with an inert solid diluent, for example, calcium carbonate, calcium phosphate or kaolin, or as soft gelatin capsules wherein the active ingredient is mixed with water or an oil medium, for example peanut oil, liquid paraffin or olive oil.

Aqueous suspensions contain the active materials in a mixture with excipients suitable for the manufacture of aqueous suspensions. Such excipients are suspending agents, for example sodium carboxymethylcellulose, methylcellulose, hydropropyl-methylcellulose, sodium alginate, polyvinylpyrrolidone, gum tragacanth and gum acacia; dispersing or wetting agents can be a naturally-occurring phosphatide, for example, lecithin, or condensation products of an alkylene oxide with fatty acids, for example polyoxyethylene stearate; or condensation products of ethylene oxide with long chain aliphatic alcohols, for example heptadecaethyleneoxycetanol, or condensation products of ethylene oxide with partial esters derived from fatty acids and a hexitol such as polyoxyethylene sorbitol monooleate, or condensation products of ethylene oxide with partial esters derived from fatty acids and hexitol anhydrides, for example polyethylene sorbitan monooleate. The aqueous suspensions can also contain one or more preservatives, for example ethyl, or n-propyl p-hydroxybenzoate, one or more coloring agents, one or more flavoring agents, and one or more sweetening agents, such as sucrose or saccharin.

Oily suspensions can be formulated by suspending the active ingredients in a vegetable oil, for example arachis oil, olive oil, sesame oil or coconut oil, or in a mineral oil such as liquid paraffin. The oily suspensions can contain a thickening agent, for example beeswax, hard paraffin or cetyl alcohol. Sweetening agents and flavoring agents can be added to provide palatable oral preparations. These compositions can be preserved by the addition of an anti-oxidant such as ascorbic acid Pharmaceutical compositions of the invention can also be in the form of oil-in-water emulsions. The oily phase can be a vegetable oil or a mineral oil or mixtures of these. Suitable emulsifying agents can be naturally-occurring gums, for example gum acacia or gum tragacanth, naturally-occurring phosphatides, for example soy bean, lecithin, and esters or partial esters derived from fatty acids and hexitol, anhydrides, for example sorbitan monooleate, and condensation products of the said partial esters with ethylene oxide, for example polyoxyethylene sorbitan monooleate. The emulsions can also contain sweetening and flavoring agents.

Syrups and elixirs can be formulated with sweetening agents, for example glycerol, propylene glycol, sorbitol, glucose or sucrose. Such formulations can also contain a demulcent, a preservative and flavoring and coloring agents. The pharmaceutical compositions can be in the form of a sterile injectable aqueous or oleaginous suspension. This suspension can be formulated according to the known art using those suitable dispersing or wetting agents and suspending agents that have been mentioned above. The sterile injectable preparation can also be a sterile injectable solution or suspension in a non-toxic parentally acceptable diluent or solvent, for example as a solution in 1,3-butanediol. Among the acceptable vehicles and solvents that can be employed are water, Ringer's solution and isotonic sodium chloride solution. In addition, sterile, fixed oils are conventionally employed as a solvent or suspending medium. For this purpose, any bland fixed oil can be employed including synthetic mono- or diglycerides. In addition, fatty acids such as oleic acid find use in the preparation of injectables.

The nucleic acid molecules of the invention can also be administered in the form of suppositories, e.g., for rectal administration of the drug. These compositions can be prepared by mixing the drug with a suitable non-irritating excipient that is solid at ordinary temperatures but liquid at the rectal temperature and will therefore melt in the rectum to release the drug. Such materials include cocoa butter and polyethylene glycols.

Nucleic acid molecules of the invention can be administered parenterally in a sterile medium. The drug, depending on the vehicle and concentration used, can either be suspended or dissolved in the vehicle. Advantageously, adjuvants such as local anesthetics, preservatives and buffering agents can be dissolved in the vehicle.

In other embodiments, the siNA and LNP compositions, or conjugates, and or delivery formulations provided herein for use in pulmonary delivery further comprise one or more surfactants. Suitable surfactants or surfactant components for enhancing the uptake of the compositions of the invention include synthetic and natural as well as full and truncated forms of surfactant protein A, surfactant protein B, surfactant protein C, surfactant protein D and surfactant Protein E, di-saturated phosphatidylcholine (other than dipalmitoyl), dipalmitoylphosphatidylcholine, phosphatidylcholine, phosphatidylglycerol, phosphatidylinositol, phosphatidylethanolamine, phosphatidylserine; phosphatidic acid, ubiquinones, lysophosphatidylethanolamine, lysophosphatidylcholine, palmitoyl-lysophosphatidylcholine, dehydroepiandrosterone, dolichols, sulfatidic acid, glycerol-3-phosphate, dihydroxyacetone phosphate, glycerol, glycero-3-phosphocholine, dihydroxyacetone, palmitate, cytidine diphosphate (CDP) diacylglycerol, CDP choline, choline, choline phosphate; as well as natural and artificial lamellar bodies which are the natural carrier vehicles for the components of surfactant, omega-3 fatty acids, polyenic acid, polyenoic acid, lecithin, palmitinic acid, non-ionic block copolymers of ethylene or propylene oxides, polyoxypropylene, monomeric and polymeric, polyoxyethylene, monomeric and polymeric, poly (vinyl amine) with dextran and/or alkanoyl side chains, Brij 35, Triton X-100 and synthetic surfactants ALEC, Exosurf, Survan and Atovaquone, among others. These surfactants can be used either as single or part of a multiple component surfactant in a formulation, or as covalently bound additions to the 5' and/or 3' ends of the nucleic acid component of a pharmaceutical composition herein.

b. Combinations

The siNAs and pharmaceutical formulations according to the invention can be administered to a subject alone or used in combination with or include one or more other therapeutic agents, for example, antiviral or anticancer agents. Thus, combinations of the presently disclosed compounds with other antiviral or anti-cancer or chemotherapeutic agents are within the scope of the invention Examples of anti-cancer or chemotherapeutic agents can be found in *Cancer Principles and Practice of Oncology* by V. T. Devita and S. Hellman (editors), 6$^{th}$ edition (Feb. 15, 2001), Lippincott Williams & Wilkins Publishers. A person of ordinary skill in the art would be able to discern which combinations of agents would be useful based on the particular characteristics of the drugs and the cancer involved. Such anti-cancer agents include, but are not limited to, the following: estrogen receptor modulators, androgen receptor modulators, retinoid receptor modulators, cytotoxic/cytostatic agents, antiproliferative agents, prenyl-protein transferase inhibitors, HMG-COA reductase inhibitors and other angiogenesis inhibitors, inhibitors of cell proliferation and survival signaling, apoptosis inducing agents and agents that interfere with cell cycle checkpoints.

In a further embodiment, therefore, the invention provides a combination comprising an siNA molecule of the invention or a pharmaceutically acceptable salt, solvate or physiologically functional derivative thereof together with one or more therapeutic agents as described herein or as is otherwise known in the art.

Examples of estrogen receptor modulators that can be used in combination with the compounds of the invention include, but are not limited to, tamoxifen, raloxifene, idoxifene, LY353381, LY117081, toremifene, fulvestrant, 4-[7-(2,2-dimethyl-1-oxopropoxy-4-methyl-2-[4-[2-(1-piperidinyl)ethoxy]phenyl]-2H-1-benzopyran-3-yl]-phenyl-2,2-dimethylpropanoate, 4,4'-dihydroxybenzophenone-2,4-dinitrophenyl-hydrazone, and SH646.

Examples of androgen receptor modulators that can be used in combination with the compounds of the invention include, but are not limited to, finasteride and other 5α-reductase inhibitors, nilutamide, flutamide, bicalutamide, liarozole, and abiraterone acetate.

Examples of such retinoid receptor modulators that can be used in combination with the compounds of the invention include, but are not limited to, bexarotene, tretinoin, 13-cis-retinoic acid, 9-cis-retinoic acid, α-difluoromethylornithine, ILX23-7553, trans-N-(4'-hydroxyphenyl) retinamide, and N-4-carboxyphenyl retinamide.

Examples of cytotoxic agents that can be used in combination with the compounds of the invention include, but are not limited to, sertenef, cachectin, ifosfamide, tasonermin, lonidamine, carboplatin, altretamine, prednimustine, dibromodulcitol, ranimustine, fotemustine, nedaplatin, oxaliplatin, temozolomide, heptaplatin, estramustine, improsulfan tosilate, trofosfamide, nimustine, dibrospidium chloride, pumitepa, lobaplatin, satraplatin, profiromycin, cisplatin, irofulven, dexifosfamide, cis-aminedichloro(2-methyl-pyridine)platinum, benzylguanine, glufosfamide, GPX100, (trans, trans, trans)-bis-mu-(hexane-1,6-diamine)-mu-[diamine-platinum(II)]bis[diamine(chloro)platinum (II)]tetrachloride, diarizidinylspermine, arsenic trioxide, 1-(11-dodecylamino-10-hydroxyundecyl)-3,7-dimethylxanthine, zorubicin, idarubicin, daunorubicin, bisantrene, mitoxantrone, pirarubicin, pinafide, valrubicin, amrubicin, antineoplaston, 3'-deamino-3'-morpholino-13-deoxo-10-hydroxycarminomycin, annamycin, galarubicin, elinafide, MEN10755, and 4-demethoxy-3-deamino-3-aziridinyl-4-methylsulphonyl-daunorubicin (see WO 00/50032).

An example of a hypoxia activatable compound that can be used in combination with the compounds of the invention is tirapazamine.

Examples of proteasome inhibitors that can be used in combination with the compounds of the invention include, but are not limited to, lactacystin and bortezomib.

Examples of microtubule inhibitors/microtubule-stabilising agents that can be used in combination with the compounds of the invention include, but are not limited to, paclitaxel, vindesine sulfate, 3',4'-didehydro-4'-deoxy-8'-norvincaleukoblastine, docetaxol, rhizoxin, dolastatin, mivobulin isethionate, auristatin, cemadotin, RPR109881, BMS184476, vinflunine, cryptophycin, 2,3,4,5,6-pentafluoro-N-(3-fluoro-4-methoxyphenyl)benzene sulfonamide, anhydrovinblastine, N,N-dimethyl-L-valyl-L-valyl-N-methyl-L-valyl-L-prolyl-L-proline-t-butylamide, TDX258, the epothilones (see for example U.S. Pat. Nos. 6,284,781 and 6,288,237) and BMS188797.

Some examples of topoisomerase inhibitors that can be used in combination with the compounds of the invention include, but are not limited to, are topotecan, hycaptamine, irinotecan, rubitecan, 6-ethoxypropionyl-3',4'-O-exo-benzylidene-chartreusin, 9-methoxy-N,N-dimethyl-5-nitropyrazolo[3,4,5-kl]acridine-2-(6H) propanamine, 1-amino-9-ethyl-5-fluoro-2,3-dihydro-9-hydroxy-4-methyl-$^{1}$H, 12H-benzo[de]pyrano[3',4":b, 7]-indolizino[1,2b]quinoline-10,13(9H,15H)dione, lurtotecan, 7-[2-(N-isopropylamino) ethyl]-(20S)camptothecin, BNP1350, BNPI1100, BN80915, BN80942, etoposide phosphate, teniposide, sobuzoxane, 2'-dimethylamino-2'-deoxy-etoposide, GL331, N-[2-(dimethylamino)ethyl]-9-hydroxy-5,6-dimethyl-6H-pyrido[4,3-b]carbazole-1-carboxamide, asulacrine, (5a, 5aB, 8aa, 9b)-

9-[2-[N-[2-(dimethylamino)ethyl]-N-methylamino]ethyl]-5-[4-hydroxy-3,5-dimethoxyphenyl]-5,5a,6,8,8a,9-hexohydrofuro(3',4':6,7)naphtho(2,3-d)-1,3-dioxol-6-one, 2,3-(methylenedioxy)-5-methyl-7-hydroxy-8-methoxy-benzo[c]-phenanthridinium, 6,9-bis[(2-aminoethyl)amino] benzo[g]isoquinoline-5,10-dione, 5-(3-aminopropylamino)-7,10-dihydroxy-2-(2-hydroxyethylaminomethyl)-6H-pyrazolo[4,5,1-de]acridin-6-one, N-[1-[2(diethylamino) ethylamino]-7-methoxy-9-oxo-9H-thioxanthen-4-ylmethyl] formamide, N-(2-(dimethylamino)ethyl)acridine-4-carboxamide, 6-[[2-(dimethylamino)ethyl]amino]-3-hydroxy-7H-indeno[2,1-c]quinolin-7-one, and dimesna.

Examples of inhibitors of mitotic kinesins, and in particular the human mitotic kinesin KSP, that can be used in combination with the compounds of the invention include, but are not limited to, inhibitors described in PCT Publications WO 01/30768, WO 01/98278, WO 03/050,064, WO 03/050, 122, WO 03/049,527, WO 03/049,679, WO 03/049, 678, WO04/039774, WO03/079973, WO03/099211, WO03/105855, WO03/106417, WO04/037171, WO04/058148, WO04/058700, WO04/126699, WO05/018638, WO05/019206, WO05/019205, WO05/018547, WO05/017190, US2005/0176776. In an embodiment inhibitors of mitotic kinesins include, but are not limited to inhibitors of KSP, inhibitors of MKLP1, inhibitors of CENP-E, inhibitors of MCAK, inhibitors of Kif14, inhibitors of Mphosph1 and inhibitors of Rab6-KIFL.

Examples of "histone deacetylase inhibitors" that can be used in combination with the compounds of the invention include, but are not limited to, TSA, oxamflatin, PXD101, MG98, valproic acid and scriptaid. Further reference to other histone deacetylase inhibitors may be found in the following manuscript; Miller, T. A. et al. J. Med. Chem. 46(24):5097-5116 (2003).

Inhibitors of kinases involved in mitotic progression that can be used in combination with the compounds of the invention include, but are not limited to, inhibitors of aurora kinase, inhibitors of Polo-like kinases (PLK) (in particular inhibitors of PLK-1), inhibitors of bub-1 and inhibitors of bub-$R_1$.

Antiproliferative agents that can be used in combination with the compounds of the invention include, but are not limited to, antisense RNA and DNA oligonucleotides such as G3139, ODN698, RVASKRAS, GEM231, and INX3001, and antimetabolites such as enocitabine, carmofur, tegafur, pentostatin, doxifluridine, trimetrexate, fludarabine, capecitabine, galocitabine, cytarabine ocfosfate, fosteabine sodium hydrate, raltitrexed, paltitrexid, emitefur, tiazofurin, decitabine, nolatrexed, pemetrexed, nelzarabine, 2'-deoxy-2'-methylidenecytidine, 2'-fluoromethylene-2'-deoxycytidine, N-[5-(2,3-dihydro-benzofuryl)sulfonyl]-N'-(3,4-dichloro-phenyl)urea, N6-[4-deoxy-4-[N2-[2(E),4(E)-tetradecadienoyl]glycylamino]-L-glycero-B-L-manno-heptopyranosyl] adenine, aplidine, ecteinascidin, troxacitabine, 4-[2-amino-4-oxo-4,6,7,8-tetrahydro-3H-pyrimidino[5,4-b][1,4]thiazin-6-yl-(S)-ethyl]-2,5-thienoyl-L-glutamic acid, aminopterin, 5-flurouracil, alanosine, 11-acetyl-8-(carbamoyloxymethyl)-4-formyl-6-methoxy-14-oxa-1,11-diazatetracyclo (7.4.1.0.0)-tetradeca-2,4,6-trien-9-yl acetic acid ester, swainsonine, lometrexol, dexrazoxane, methioninase, 2'-cyano-2'-deoxy-N4-palmitoyl-1-B-D-arabino furanosyl cytosine and 3-aminopyridine-2-carboxaldehyde thiosemicarbazone.

Examples of monoclonal antibody targeted therapeutic agents that can be used in combination with the compounds of the invention include those therapeutic agents which have cytotoxic agents or radioisotopes attached to a cancer cell specific or target cell specific monoclonal antibody, such as, for example, Bexxar.

Examples of HMG-COA reductase inhibitors that may be used in combination with the compounds of the invention include, but are not limited to, lovastatin (MEVACOR®; see U.S. Pat. Nos. 4,231,938, 4,294,926 and 4,319,039), simvastatin (ZOCOR®; see U.S. Pat. Nos. 4,444,784, 4,820,850 and 4,916,239), pravastatin (PRAVACHOL®; see U.S. Pat. Nos. 4,346,227, 4,537,859, 4,410,629, 5,030,447 and 5,180,589), fluvastatin (LESCOL®; see U.S. Pat. Nos. 5,354,772, 4,911,165, 4,929,437, 5,189,164, 5,118,853, 5,290,946 and 5,356,896) and atorvastatin (LIPITOR®; see U.S. Pat. Nos. 5,273,995, 4,681,893, 5,489,691 and 5,342,952). The structural formulas of these and additional HMG-COA reductase inhibitors that may be used in the instant methods are described at page 87 of M. Yalpani, "Cholesterol Lowering Drugs", *Chemistry & Industry*, pp. 85-89 (5 Feb. 1996) and U.S. Pat. Nos. 4,782,084 and 4,885,314.

Examples of prenyl-protein transferase inhibitors that can be used in combination with the compounds of the invention include, but are not limited to, can be found in the following publications and patents: WO 96/30343, WO 97/18813, WO 97/21701, WO 97/23478, WO 97/38665, WO 98/28980, WO 98/29119, WO 95/32987, U.S. Pat. Nos. 5,420,245, 5,523,430, 5,532,359, 5,510,510, 5,589,485, 5,602,098, European Patent Publ. 0 618 221, European Patent Publ. 0 675 112, European Patent Publ. 0 604 181, European Patent Publ. 0 696 593, WO 94/19357, WO 95/08542, WO 95/11917, WO 95/12612, WO 95/12572, WO 95/10514, U.S. Pat. No. 5,661,152, WO 95/10515, WO 95/10516, WO 95/24612, WO 95/34535, WO 95/25086, WO 96/05529, WO 96/06138, WO 96/06193, WO 96/16443, WO 96/21701, WO 96/21456, WO 96/22278, WO 96/24611, WO 96/24612, WO 96/05168, WO 96/05169, WO 96/00736, U.S. Pat. No. 5,571,792, WO 96/17861, WO 96/33159, WO 96/34850, WO 96/34851, WO 96/30017, WO 96/30018, WO 96/30362, WO 96/30363, WO 96/31111, WO 96/31477, WO 96/31478, WO 96/31501, WO 97/00252, WO 97/03047, WO 97/03050, WO 97/04785, WO 97/02920, WO 97/17070, WO 97/23478, WO 97/26246, WO 97/30053, WO 97/44350, WO 98/02436, and U.S. Pat. No. 5,532,359. For an example of the role of a prenyl-protein transferase inhibitor on angiogenesis see *European J. of Cancer*, Vol. 35, No. 9, pp. 1394-1401 (1999).

Examples of angiogenesis inhibitors that can be used in combination with the compounds of the invention include, but are not limited to, tyrosine kinase inhibitors, such as inhibitors of the tyrosine kinase receptors Flt-1 (VEGFR1) and Flk-1/KDR (VEGFR2), inhibitors of epidermal-derived, fibroblast-derived, or platelet derived growth factors, MMP (matrix metalloprotease) inhibitors, integrin blockers, interferon-α, interleukin-12, pentosan polysulfate, cyclooxygenase inhibitors, including nonsteroidal anti-inflammatoires (NSAIDs) like aspirin and ibuprofen as well as selective cyclooxy-genase-2 inhibitors like celecoxib and rofecoxib (*PNAS*, Vol. 89, p. 7384 (1992); *JNCI*, Vol. 69, p. 475 (1982); *Arch. Opthalmol.*, Vol. 108, p. 573 (1990); *Anat. Rec.*, Vol. 238, p. 68 (1994); *FEBS Letters*, Vol. 372, p. 83 (1995); Clin, Orthop. Vol. 313, p. 76 (1995); *J. Mol. Endocrinol.*, Vol. 16, p. 107 (1996); *Jpn. J. Pharmacol.*, Vol. 75, p. 105 (1997); *Cancer Res.*, Vol. 57, p. 1625 (1997); *Cell*, Vol. 93, p. 705 (1998); *Intl. J. Mol. Med.*, Vol. 2, p. 715 (1998); *J. Biol. Chem.*, Vol. 274, p. 9116 (1999)), steroidal anti-inflammatoir (such as corticosteroids, mineralocorticoids, dexamethasone, prednisone, prednisolone, methylpred, betamethasone), carboxyamidotriazole, combretastatin A-4, squalamine, 6-O-chloroacetyl-carbonyl)-fumagillol, thalidomide, angiostatin, troponin-1, angiotensin II antagonists (see Fernandez et al., *J. Lab. Clin. Med.* 105:141-145 (1985)), and antibodies to VEGF (see, *Nature Biotechnology*, Vol. 17, pp. 963-968 (October 1999); Kim et al., *Nature*, 362, 841-844 (1993); WO 00/44777; and WO 00/61186).

Other therapeutic agents that modulate or inhibit angiogenesis may also be used in combination with the compounds of the instant invention and include agents that modulate or inhibit the coagulation and fibrinolysis systems (see review in *Clin. Chem. La. Med.* 38:679-692 (2000)). Examples of such agents that modulate or inhibit the coagulation and fibrinolysis pathways that can be used in combination with the compounds of the invention include, but are not limited to, heparin (see *Thromb. Haemost.* 80:10-23 (1998)), low molecular weight heparins and carboxypeptidase U inhibitors (also known as inhibitors of active thrombin activatable fibrinolysis inhibitor [TAFIa]) (see *Thrombosis Res.* 101:329-354 (2001)). TAFIa inhibitors have been described in PCT Publication WO 03/013,526 and U.S. Ser. No. 60/349,925 (filed Jan. 18, 2002).

Agents that interfere with cell cycle checkpoints that can be used in combination with the compounds of the invention include, but are not limited to, inhibitors of ATR, ATM, the Chk1 and Chk2 kinases and cdk and cdc kinase inhibitors and are specifically exemplified by 7-hydroxystaurosporin, flavopiridol, CYC202 (Cyclacel) and BMS-387032.

Agents that interfere with receptor tyrosine kinases (RTKs) that can be used in combination with the compounds of the invention include, but are not limited to, inhibitors of c-Kit, Eph, PDGF, Flt3 and HBV. Further agents include inhibitors of RTKs as described by Bume-Jensen and Hunter, *Nature*, 411:355-365, 2001.

Inhibitors of cell proliferation and survival signaling pathway that can be used in combination with the compounds of the invention include, but are not limited to, inhibitors of EGFR (for example gefitinib and erlotinib), inhibitors of ERB-2 (for example trastuzumab), inhibitors of IGFR, inhibitors of cytokine receptors, inhibitors of HBV, inhibitors of PI3K (for example LY294002), serine/threonine kinases (including but not limited to inhibitors of Akt such as described in WO 02/083064, WO 02/083139, WO 02/083140, US 2004-0116432, WO 02/083138, US 2004-0102360, WO 03/086404, WO 03/086279, WO 03/086394, WO 03/084473, WO 03/086403, WO 2004/041162, WO 2004/096131, WO 2004/096129, WO 2004/096135, WO 2004/096130, WO 2005/100356, WO 2005/100344), inhibitors of Raf kinase (for example BAY-43-9006), inhibitors of MEK (for example CI-1040 and PD-098059) and inhibitors of mTOR (for example Wyeth CCI-779). Such agents include small molecule inhibitor compounds and antibody antagonists.

Apoptosis inducing agents that can be used in combination with the compounds of the invention include, but are not limited to, activators of TNF receptor family members (including the TRAIL receptors).

NSAIDs that are selective COX-2 inhibitors that can be used in combination with the compounds of the invention include, but are not limited to, those NSAIDs disclosed in U.S. Pat. Nos. 5,474,995, 5,861,419, 6,001,843, 6,020,343, 5,409,944, 5,436,265, 5,536,752, 5,550,142, 5,604,260, 5,698,584, 5,710,140, WO 94/15932, U.S. Pat. Nos. 5,344, 991, 5,134,142, 5,380,738, 5,393,790, 5,466,823, 5,633,272, and 5,932,598, all of which are hereby incorporated by reference.

Inhibitors of COX-2 that are particularly useful in combination with the compounds of the invention include: 3-phenyl-4-(4-(methylsulfonyl)phenyl)-2-(5H)-furanone; and 5-chloro-3-(4-methylsulfonyl)-phenyl-2-(2-methyl-5-pyridinyl)pyridine; or a pharmaceutically acceptable salt thereof.

Compounds that have been described as specific inhibitors of COX-2 and are therefore useful in the present invention include, but are not limited to: parecoxib, CELEBREX® and BEXTRA® or a pharmaceutically acceptable salt thereof.

Angiogenesis inhibitors that can be used in combination with the compounds of the invention include, but are not limited to, endostatin, ukrain, ranpirnase, IM862, 5-methoxy-4-[2-methyl-3-(3-methyl-2-butenyl)oxiranyl]-1-oxaspiro[2,5]oct-6-yl(chloroacetyl)carbamate, acetyldinanaline, 5-amino-1-[[3,5-dichloro-4-(4-chlorobenzoyl)-phenyl]methyl]-$^1$H-1,2,3-triazole-4-carboxamide, CM101, squalamine, combretastatin, RPI4610, NX31838, sulfated mannopentaose phosphate, 7,7-(carbonyl-bis[imino-N-methyl-4,2-pyrrolocarbonylimino[N-methyl-4,2-pyrrole]-carbonylimino]-bis-(1,3-naphthalene disulfonate), and 3-[(2,4-dimethylpyrrol-5-yl)methylene]-2-indolinone (SU5416).

Tyrosine kinase inhibitors that can be used in combination with the compounds of the invention include, but are not limited to, N-(trifluoromethylphenyl)-5-methylisoxazol-4-carboxamide, 3-[(2,4-dimethylpyrrol-5-yl)methylidenyl)indolin-2-one, 17-(allylamino)-17-demethoxygeldanamycin, 4-(3-chloro-4-fluorophenylamino)-7-methoxy-6-[3-(4-morpholinyl)propoxyl]quinazoline, N-(3-ethynylphenyl)-6,7-bis(2-methoxyethoxy)-4-quinazolinamine, BIBX1382, 2,3,9,10,11,12-hexahydro-10-(hydroxymethyl)-10-hydroxy-9-methyl-9,12-epoxy-$^1$H-diindolo[1,2,3-fg:3',2',1'-kl]pyrrolo[3,4-i][1,6]benzodiazocin-1-one, SH268, genistein, imatinib (STI571), CEP2563, 4-(3-chlorophenylamino)-5,6-dimethyl-7H-pyrrolo[2,3-d]pyrimidinemethane sulfonate, 4-(3-bromo-4-hydroxyphenyl)amino-6,7-dimethoxyquinazoline, 4-(4'-hydroxyphenyl)amino-6,7-dimethoxyquinazoline, SU6668, STI571A, N-4-chlorophenyl-4-(4-pyridylmethyl)-1-phthalazinamine, and EMD121974.

Combinations with compounds other than anti-cancer compounds are also encompassed in the instant compositions and methods. For example, combinations of the instantly claimed compounds with PPAR-γ (i.e., PPAR-gamma) agonists and PPAR-δ (i.e., PPAR-delta) agonists are useful in the treatment of certain malignancies. PPAR-γ and PPAR-δ are the nuclear peroxisome proliferator-activated receptors γ and δ. The expression of PPAR-γ on endothelial cells and its involvement in angiogenesis has been reported in the literature (see *J. Cardiovasc. Pharmacol.* 31:909-913 (1998); *J. Biol. Chem.* 274:9116-9121 (1999); *Invest. Ophthalmol Vis. Sci.* 41:2309-2317 (2000)). More recently, PPAR-γ agonists have been shown to inhibit the angiogenic response to VEGF in vitro; both troglitazone and rosiglitazone maleate inhibit the development of retinal neovascularization in mice. (*Arch. Ophthamol.* 119:709-717 (2001)). Examples of PPAR-γ agonists and PPAR-γ/α agonists that can be used in combination with the compounds of the invention include, but are not limited to, thiazolidinediones (such as DRF2725, CS-011, troglitazone, rosiglitazone, and pioglitazone), fenofibrate, gemfibrozil, clofibrate, GW2570, SB219994, AR-H039242, JTT-501, MCC-555, GW2331, GW409544, NN2344, KRP297, NP0110, DRF4158, NN622, GI262570, PNU182716, DRF552926, 2-[(5,7-dipropyl-3-trifluoromethyl-1,2-benzisoxazol-6-yl)oxy]-2-methylpropionic acid (disclosed in U.S. Ser. No. 09/782, 856), and 2(R)-7-(3-(2-chloro-4-(4-fluorophenoxy) phenoxy)propoxy)-2-ethylchromane-2-carboxylic acid (disclosed in U.S. Ser. No. 60/235,708 and 60/244,697).

Another embodiment of the instant invention is the use of the presently disclosed compounds in combination with gene therapy for the treatment of cancer. For an overview of genetic strategies to treating cancer see Hall et al. (Am J Hum Genet 61:785-789 (1997)) and Kufe et al. (*Cancer Medicine,* 5th Ed, pp 876-889, BC Decker, Hamilton, 2000). Gene therapy can be used to deliver any tumor suppressing gene. Examples of such genes include, but are not limited to, p53, which can be delivered via recombinant virus-mediated gene transfer (see U.S. Pat. No. 6,069,134, for example), a uPA/uPAR antagonist ("Adenovirus-Mediated Delivery of a uPA/uPAR Antagonist Suppresses Angiogenesis-Dependent Tumor Growth and Dissemination in Mice," *Gene Therapy*, August 5(8): 1105-13 (1998)), and interferon gamma (*J Immunol* 164:217-222 (2000)).

The compounds of the instant invention may also be administered in combination with an inhibitor of inherent multidrug resistance (MDR), in particular MDR associated with high levels of expression of transporter proteins. Such MDR inhibitors include inhibitors of p-glycoprotein (P-gp), such as LY335979, XR9576, OC144-093, R101922, VX853 and PSC833 (valspodar).

A compound of the present invention may be employed in conjunction with anti-emetic agents to treat nausea or emesis, including acute, delayed, late-phase, and anticipatory emesis, which may result from the use of a compound of the present invention, alone or with radiation therapy. For the prevention or treatment of emesis, a compound of the present invention may be used in conjunction with other anti-emetic agents, especially neurokinin-1 receptor antagonists, 5HT3 receptor antagonists, such as ondansetron, granisetron, tropisetron, and zatisetron, GABAB receptor agonists, such as baclofen, a corticosteroid such as Decadron (dexamethasone), Kenalog, Aristocort, Nasalide, Preferid, Benecorten or others such as disclosed in U.S. Pat. Nos. 2,789,118, 2,990,401, 3,048,581, 3, 126,375, 3,929,768, 3,996,359, 3,928,326 and 3,749,712, an antidopaminergic, such as the phenothiazines (for example prochlorperazine, fluphenazine, thioridazine and mesoridazine), metoclopramide or dronabinol. In an embodiment, an anti-emesis agent selected from a neurokinin-1 receptor antagonist, a 5HT3 receptor antagonist and a corticosteroid is administered as an adjuvant for the treatment or prevention of emesis that may result upon administration of the instant compounds.

Neurokinin-1 receptor antagonists of use in conjunction with the compounds of the present invention are fully described, for example, in U.S. Pat. Nos. 5,162,339, 5,232, 929, 5,242,930, 5,373,003, 5,387,595, 5,459,270, 5,494,926, 5,496,833, 5,637,699, 5,719,147; European Patent Publication Nos. EP 0 360 390, 0 394 989, 0 428 434, 0 429 366, 0 430 771, 0 436 334, 0 443 132, 0 482 539, 0 498 069, 0 499 313, 0 512 901, 0 512 902, 0 514 273, 0 514 274, 0 514 275, 0 514 276, 0 515 681, 0 517 589, 0 520 555, 0 522 808, 0 528 495, 0 532 456, 0 533 280, 0 536 817, 0 545 478, 0 558 156, 0 577 394, 0 585 913,0 590 152, 0 599 538, 0 610 793, 0 634 402, 0 686 629, 0 693 489, 0 694 535, 0 699 655, 0 699 674, 0 707 006, 0 708 101, 0 709 375, 0 709 376, 0 714 891, 0 723 959, 0 733 632 and 0 776 893; PCT International Patent Publication Nos. WO 90/05525, 90/05729, 91/09844, 91/18899, 92/01688, 92/06079, 92/12151, 92/15585, 92/17449, 92/20661, 92/20676, 92/21677, 92/22569, 93/00330, 93/00331, 93/01159, 93/01165, 93/01169, 93/01170, 93/06099, 93/09116, 93/10073, 93/14084, 93/14113, 93/18023, 93/19064, 93/21155, 93/21181, 93/23380, 93/24465, 94/00440, 94/01402, 94/02461, 94/02595, 94/03429, 94/03445, 94/04494, 94/04496, 94/05625, 94/07843, 94/08997, 94/10165, 94/10167, 94/10168, 94/10170, 94/11368, 94/13639, 94/13663, 94/14767, 94/15903, 94/19320, 94/19323, 94/20500, 94/26735, 94/26740, 94/29309, 95/02595, 95/04040, 95/04042, 95/06645, 95/07886, 95/07908, 95/08549, 95/11880, 95/14017, 95/15311, 95/16679, 95/17382, 95/18124, 95/18129, 95/19344, 95/20575, 95/21819, 95/22525, 95/23798, 95/26338, 95/28418, 95/30674, 95/30687, 95/33744, 96/05181, 96/05193, 96/05203, 96/06094, 96/07649, 96/10562, 96/16939, 96/18643, 96/20197, 96/21661, 96/29304, 96/29317, 96/29326, 96/29328, 96/31214, 96/32385, 96/37489, 97/01553, 97/01554, 97/03066, 97/08144, 97/14671, 97/17362, 97/18206, 97/19084, 97/19942 and 97/21702; and in British Patent Publication Nos. 2 266 529, 2 268 931, 2 269 170, 2 269 590, 2 271 774, 2 292 144, 2 293 168, 2 293 169, and 2 302 689. The preparation of such compounds is fully described in the aforementioned patents and publications, which are incorporated herein by reference.

In an embodiment, the neurokinin-1 receptor antagonist for use in conjunction with the compounds of the present invention is selected from: 2-(R)-(1-(R)-(3,5-bis(trifluoromethyl)-phenyl)ethoxy)-3-(S)-(4-fluorophenyl)-4-(3-(5-oxo-$^1$H,4H-1,2,4-triazolo)methyl)morpholine, or a pharmaceutically acceptable salt thereof, which is described in U.S. Pat. No. 5,719,147.

A compound of the instant invention may also be administered with an agent useful in the treatment of anemia. Such an anemia treatment agent is, for example, a continuous eythropoiesis receptor activator (such as epoetin alfa).

A compound of the instant invention may also be administered with an agent useful in the treatment of neutropenia. Such a neutropenia treatment agent is, for example, a hematopoietic growth factor which regulates the production and function of neutrophils such as a human granulocyte colony stimulating factor, (G-CSF). Examples of a G-CSF include filgrastim and PEG-filgrastim.

A compound of the instant invention may also be administered with an immunologic-enhancing drug, such as levamisole, isoprinosine and Zadaxin.

A compound of the instant invention may also be useful for treating or preventing liver disease or cancer in combination with other siNA therapeutics.

The compounds of the instant invention may also be administered in combination with γ-secretase inhibitors and/or inhibitors of NOTCH signaling. Such inhibitors include compounds described in WO 01/90084, WO 02/30912, WO 01/70677, WO 03/013506, WO 02/36555, WO 03/093252, WO 03/093264, WO 03/093251, WO 03/093253, WO 2004/ 039800, WO 2004/039370, WO 2005/030731, WO 2005/ 014553, U.S. Ser. No. 10/957,251, WO 2004/089911, WO 02/081435, WO 02/081433, WO 03/018543, WO 2004/ 031137, WO 2004/031139, WO 2004/031138, WO 2004/ 101538, WO 2004/101539 and WO 02/47671 (including LY-450139).

A compound of the instant invention may also be useful for treating or preventing cancer in combination with PARP inhibitors.

A compound of the instant invention may also be useful for treating cancer in combination with the following therapeutic agents: abarelix (Plenaxis Depot®); aldesleukin (Prokine®); Aldesleukin (Proleukin®); Alemtuzumabb (Campath®); alitretinoin (Panretin®); allopurinol (Zyloprim®);

altretamine (Hexalen®); amifostine (Ethyol®); anastrozole (Arimidex®); arsenic trioxide (Trisenox®); asparaginase (Elspar®); azacitidine (Vidaza®); bendamustine hydrochloride (Treanda®); bevacuzimab (Avastin®); bexarotene capsules (Targretin®); bexarotene gel (Targretin®); bleomycin (Blenoxane®); bortezomib (Velcade®); brefeldin A; busulfan intravenous (Busulfex®); busulfan oral (Myleran®); calusterone (Methosarb®); capecitabine (Xeloda®); carboplatin (Paraplatin®); carmustine (BCNU®); BiCNU®); carmustine (Gliadel®); carmustine with Polifeprosan 20 Implant (Gliadel Wafer®); celecoxib (Celebrex®); cetuximab (Erbitux®); chlorambucil (Leukeran®); cisplatin (Platinol®); cladribine (Leustatin®, 2-CdA®); clofarabine (Clolar®); cyclophosphamide (Cytoxan®, Neosar®); cyclophosphamide (Cytoxan Injection®); cyclophosphamide (Cytoxan Tablet®); cytarabine (Cytosar-U®); cytarabine liposomal (DepoCyt®); dacarbazine (DTIC-Dome®); dactinomycin, actinomycin D (Cosmegen®); dalteparin sodium injection (Fragmin®); Darbepoetin alfa (Aranesp®); dasatinib (Sprycel®); daunorubicin liposomal (DanuoXome®); daunorubicin, daunomycin (Daunorubicin®); daunorubicin, daunomycin (Cerubidine®); degarelix (Firmagon®); Denileukin diftitox (Ontak®); dexrazoxane (Zinecard®); dexrazoxane hydrochloride (Totect®); didemnin B; 17-DMAG; docetaxel (Taxotere®); doxorubicin (Adriamycin PFS®); doxorubicin (Adriamycin®, Rubex®); doxorubicin (Adriamycin PFS Injection®); doxorubicin liposomal (Doxil®); dromostanolone propionate (Dromostanolone®); dromostanolone propionate (Masterone Injection®); eculizumab injection (Soliris®); Elliott's B Solution (Elliott's B Solution®); eltrombopag (Promacta®); epirubicin (Ellence®); Epoetin alfa (Epogen®); erlotinib (Tarceva®); estramustine (Emcyt®); ethinyl estradiol; etoposide phosphate (Etopophos®); etoposide, VP-16 (Vepesid®); everolimus tablets (Afinitor®); exemestane (Aromasin®); ferumoxytol (Feraheme Injection®); Filgrastim (Neupogen®); floxuridine (intraarterial) (FUDR®); fludarabine (Fludara®); fluorouracil, 5-FU (Adrucil®); fulvestrant (Faslodex®); gefitinib (Iressa®); geldanamycin; gemcitabine (Gemzar®); gemtuzumab ozogamicin (Mylotarg®); goserelin acetate (Zoladex Implant®); goserelin acetate (Zoladex®); histrelin acetate (Histrelin Implant®); hydroxyurea (Hydrea®); Ibritumomab Tiuxetan (Zevalin®); idarubicin (Idamycin®); ifosfamide (IFEX®); imatinib mesylate (Gleevec®); interferon alfa 2a (Roferon A®); Interferon alfa-2b (Intron A®); iobenguane I 123 injection (AdreView®); irinotecan (Camptosar®); ixabepilone (Ixempra®); lapatinib tablets (Tykerb®); lenalidomide (Revlimid®); letrozole (Femara®); leucovorin (Wellcovorin®, Leucovorin®); Leuprolide Acetate (Eligard®); levamisole (Ergamisol®); lomustine, CCNU (CeeBU®); meclorethamine, nitrogen mustard (Mustargen®); megestrol acetate (Megace®); melphalan, L-PAM (Alkeran®); mercaptopurine, 6-MP (Purinethol®); mesna (Mesnex®); mesna (Mesnex Tabs®); methotrexate (Methotrexate®); methoxsalen (Uvadex®); 8-methoxypsoralen; mitomycin C (Mutamycin®); mitotane (Lysodren®); mitoxantrone (Novantrone®); mitramycin; nandrolone phenpropionate (Durabolin-50®); nelarabine (Arranon®); nilotinib (Tasigna®); Nofetumomab (Verluma®); ofatumumab (Arzerra®); Oprelvekin (Neumega®); oxaliplatin (Eloxatin®); paclitaxel (Paxene®); paclitaxel (Taxol®); paclitaxel protein-bound particles (Abraxane®); palifermin (Kepivance®); pamidronate (Aredia®); panitumumab (Vectibix); pazopanib tablets (Votrienttm®); pegademase (Adagen (Pegademase Bovine)®); pegaspargase (Oncaspar®); Pegfilgrastim (Neulasta®); pemetrexed disodium (Alimta®); pentostatin (Nipent®); pipobroman (Vercyte®); plerixafor (Mozobil®); plicamycin, mithramycin (Mithracin®); porfimer sodium (Photofrin®); pralatrexate injection (Folotyn®); procarbazine (Matulane®); quinacrine (Atabrine®); rapamycin; Rasburicase (Elitek®); raloxifene hydrochloride (Evista®); Rituximab (Rituxan®); romidepsin (Istodax®); romiplostim (Nplate®); sargramostim (Leukine®); Sargramostim (Prokine®); sorafenib (Nexavar®); streptozocin (Zanosar®); sunitinib maleate (Sutent®); talc (Sclerosol®); tamoxifen (Nolvadex®); temozolomide (Temodar®); temsirolimus (Torisel®); teniposide, VM-26 (Vumon®); testolactone (Teslac®); thioguanine, 6-TG (Thioguanine®); thiopurine; thiotepa (Thioplex®); topotecan (Hycamtin®); toremifene (Fareston®); Tositumomab (Bexxar®); Tositumomab/I-131 tositumomab (Bexxar®); trans-retinoic acid; Trastuzumab (Herceptin®); tretinoin, ATRA (Vesanoid®); triethylenemelamine; Uracil Mustard (Uracil Mustard Capsules®); valrubicin (Valstar®); vinblastine (Velban®); vincristine (Oncovin®); vinorelbine (Navelbine®); vorinostat (Zolinza®); wortmannin; and zoledronate (Zometa®).

The invention also provides a combination comprising an siNA molecule of the invention targeting one gene together with another inhibitor targeting a second target gene.

The combinations referred to above can conveniently be presented for use in the form of a pharmaceutical formulation and thus pharmaceutical compositions comprising a combination as defined above together with a pharmaceutically acceptable diluent or carrier represent a further aspect of the invention.

To practice the coordinate administration methods of this disclosure, an siNA molecule is administered simultaneously or sequentially in a coordinated treatment protocol with one or more secondary or adjunctive therapeutic agents described herein or known in the art. The coordinate administration may be done in either order, and there may be a time period while only one or both (or all) active therapeutic agents, individually or collectively, exert their biological activities. A distinguishing aspect of all such coordinate treatment methods is that the siNA molecule(s) present in a composition elicits some favorable clinical response, which may or may not be in conjunction with a secondary clinical response provided by the secondary therapeutic agent. For example, the coordinate administration of an siNA molecule with a secondary therapeutic agent as contemplated herein can yield an enhanced (e.g., synergistic) therapeutic response beyond the therapeutic response elicited by either or both the purified siNA molecule and the secondary therapeutic agent alone.

The individual compounds of such combinations can be administered either sequentially or simultaneously in separate or combined pharmaceutical formulations. In one embodiment, the individual compounds will be administered simultaneously in a combined pharmaceutical formulation.

Thus, the described molecules could be used in combination with one or more known compounds, treatments, or procedures to prevent or treat diseases, disorders, conditions, and traits described herein in a subject or organism as are known in the art, such as other gene inhibitors.

3. Therapeutic Applications

The present body of knowledge in RNAi research indicates the need for methods that can modulate gene expression for therapeutic use.

Thus, one aspect of the invention comprises a method of treating a subject including, but not limited to, a human suffering from a disease or a condition which is mediated by the action of target gene expression, which method comprises administering to said subject an effective amount of a double-stranded siNA molecule of the invention. In one embodiment of this aspect, the siNA molecules comprises sequence having at least a 15 nucleotides complementary to a target nucleic acid. In other embodiments, the siNA molecule comprises any molecule herein having formula (A).

In some embodiments of this aspect, the disease or condition is cancer, a proliferative, inflammatory, autoimmune, neurologic, ocular, respiratory, metabolic, dermatological, auditory, liver, kidney, or infectious disease as described herein or otherwise known in the art. Thus, in certain embodiments the molecules and compositions of the instant invention are useful in a method for treating cancer, proliferative, inflammatory, autoimmune, neurologic, ocular, respiratory, metabolic, dermatological, auditory, liver, kidney, or infectious diseases.

In certain embodiments, the administration of the siNA molecule is via local administration or systemic administration. In other embodiments, the invention features contacting the subject or organism with an siNA molecule of the invention via local administration to relevant tissues or cells, such as lung cells and tissues, such as via pulmonary delivery. In yet other embodiments, the invention features contacting the subject or organism with an siNA molecule of the invention via systemic administration (such as via intravenous or subcutaneous administration of siNA) to relevant tissues or cells in a subject or organism.

siNA molecules of the invention are also used as reagents in ex vivo applications. For example, siNA reagents are introduced into tissue or cells that are transplanted into a subject for therapeutic effect. The cells and/or tissue can be derived from an organism or subject that later receives the explant, or can be derived from another organism or subject prior to transplantation. The siNA molecules can be used to modulate the expression of one or more genes in the cells or tissue, such that the cells or tissue obtain a desired phenotype or are able to perform a function when transplanted in vivo. In one embodiment, certain target cells from a patient are extracted.

These extracted cells are contacted with siNAs targeting a specific nucleotide sequence within the cells under conditions suitable for uptake of the siNAs by these cells (e.g., using delivery reagents such as cationic lipids, liposomes and the like or using techniques such as electroporation to facilitate the delivery of siNAs into cells). The cells are then reintroduced back into the same patient or other patients.

For therapeutic applications, a pharmaceutically effective dose of the siNA molecules or pharmaceutical compositions of the invention is administered to the subject. A pharmaceutically effective dose is that dose required to prevent, inhibit the occurrence, or treat (alleviate a symptom to some extent, preferably all of the symptoms) a disease state. One skilled in the art can readily determine a therapeutically effective dose of the siNA of the invention to be administered to a given subject, by taking into account factors, such as the size and weight of the subject, the extent of the disease progression or penetration, the age, health, and sex of the subject, the route of administration, and whether the administration is regional or systemic. Generally, an amount between 0.1 µg/kg and 140 mg/kg body weight/day of active ingredients is administered dependent upon potency of the siNA of the disclosure. The amount of active ingredient that can be combined with the carrier materials to produce a single dosage form varies depending upon the host treated and the particular mode of administration. Optimal dosing schedules can be calculated from measurements of drug accumulation in the body of the patient. The siNA molecules of the invention can be administered in a single dose or in multiple doses. siNA molecules of the instant invention can be administered once monthly, once weekly, once daily (QD), or divided into multiple monthly, weekly, or daily doses, such as, for example, but not limitation, twice daily (BID), three times daily (TID), once every two weeks. Persons of ordinary skill in the art can easily estimate repetition rates for dosing based on measured residence times and concentrations of the drug in bodily fluids or tissues.

In addition, the administration can be continuous, i.e., every day, or intermittently. For example, intermittent administration of a compound of the instant invention may be administration one to six days per week or it may mean administration in cycles (e.g. daily administration for two to eight consecutive weeks, then a rest period with no administration for up to one week) or it may mean administration on alternate days.

G. Administration

Compositions or formulations can be administered in a variety of ways. Non-limiting examples of administration methods of the invention include oral, buccal, sublingual, parenteral (i.e., intraarticularly, intravenously, intraperitoneally, subcutaneously, or intramuscularly), local rectal administration or other local administration. In one embodiment, the composition of the invention can be administered by insufflation and inhalation. Administration can be accomplished via single or divided doses. In some embodiments, the pharmaceutical compositions are administered intravenously or intraperitoneally by a bolus injection (see, e.g., U.S. Pat. No. 5,286,634).

An siNA molecule with or without a vehicle can be locally delivered by direct injection or by use of an infusion pump. Direct injection of the siNA molecules of this disclosure, whether subcutaneous, intramuscular, or intradermal, can take place using standard needle and syringe methodologies, or by needle free technologies, such as those described in Conroy et al, (1999, *Clin. Cancer Res.* 5:2330) and PCT Publication No. WO 99/31262. For example, but not limitation, lipid nucleic acid particles can be administered by direct injection at the site of disease or by injection at a site distal from the site of disease (see, e.g., Culver, HUMAN GENE THERAPY, Mary Ann Liebert, Inc., Publishers, New York. pp. 70-71(1994)). In one embodiment, the siNA molecules of the invention and formulations or compositions thereof are administered to a cell, subject, or organism as is described herein and as is generally known in the art.

1. In Vivo Administration

In any of the methods of treatment of the invention, the siNA can be administered to the subject systemically as described herein or otherwise known in the art, either alone as a monotherapy or in combination with additional therapies described herein or as are known in the art. Systemic administration can include, for example, pulmonary (inhalation, nebulization etc.) intravenous, subcutaneous, intramuscular, catheterization, nasopharyngeal, transdermal, or oral/gastrointestinal administration as is generally known in the art.

In any of the methods of treatment or prevention of the invention, the siNA can be administered to the subject locally or to local tissues as described herein or otherwise known in the art, either alone as a monotherapy or in combination with additional therapies as are known in the art. Local administration can include, for example, inhalation, nebulization, catheterization, implantation, direct injection, dermal/transdermal application, patches, stenting, ear/ eye drops, or portal vein administration to relevant tissues, or any other local administration technique, method or procedure, as is generally known in the art.

In one embodiment, the siNA molecules of the invention and formulations or compositions thereof are administered to the liver as is generally known in the art (see for example Wen et al., 2004, *World J Gastroenterol.*, 10, 244-9; Murao et al., 2002, *Pharm Res.*, 19, 1808-14; Liu et al., 2003, *gene Ther.*, 10, 180-7; Hong et al., 2003, *J Pharm Pharmacol.*, 54, 51-8; Herrmann et al., 2004, *Arch Virol.*, 149, 1611-7; and Matsuno et al., 2003, *gene Ther.*, 10, 1559-66).

In one embodiment, the invention features the use of methods to deliver the siNA molecules of the instant invention to hematopoietic cells, including monocytes and lymphocytes. These methods are described in detail by Hartmann et al., 1998, *J. Phamacol. Exp. Ther.*, 285(2), 920-928; Kronenwett et al., 1998, *Blood*, 91(3), 852-862; Filion and Phillips, 1997, *Biochim. Biophys. Acta.*, 1329(2), 345-356; Ma and Wei, 1996, *Leuk. Res.*, 20(11/12), 925-930; and Bongartz et al., 1994, *Nucleic Acids Research*, 22(22), 4681-8.

In one embodiment, the siNA molecules of the invention and formulations or compositions thereof are administered directly or topically (e.g., locally) to the dermis or follicles as is generally known in the art (see for example Brand, 2001, *Curr. Opin. Mol. Ther.*, 3, 244-8; Regnier et al., 1998, *J. Drug Target*, 5, 275-89; Kanikkannan, 2002, *BioDrugs*, 16, 339-47; Wraight et al., 2001, *Pharmacol. Ther.*, 90, 89-104; and Preat and Dujardin, 2001, STP PharmaSciences, 11, 57-68). In one embodiment, the siNA molecules of the invention and formulations or compositions thereof are administered directly or topically using a hydroalcoholic gel formulation comprising an alcohol (e.g., ethanol or isopropanol), water, and optionally including additional agents such isopropyl myristate and carbomer 980. In other embodiments, the siNA are formulated to be administered topically to the nasal cavity. Topical preparations can be administered by one or more applications per day to the affected area; over skin areas occlusive dressings can advantageously be used. Continuous or prolonged delivery can be achieved by an adhesive reservoir system.

In one embodiment, an siNA molecule of the invention is administered iontophoretically, for example to a particular organ or compartment (e.g., the eye, back of the eye, heart, liver, kidney, bladder, prostate, tumor, CNS etc.). Non-limiting examples of iontophoretic delivery are described in, for example, WO 03/043689 and WO 03/030989, which are incorporated by reference in their entireties herein.

In one embodiment, the siNA molecules of the invention and formulations or compositions thereof are administered to the lung as is described herein and as is generally known in the art. In another embodiment, the siNA molecules of the invention and formulations or compositions thereof are administered to lung tissues and cells as is described in U.S. Patent Publication Nos. 2006/0062758; 2006/0014289; and 2004/0077540.

2. Aerosols and Delivery Devices
a. Aerosol Formulations

The compositions of the present invention, either alone or in combination with other suitable components, can be made into aerosol formulations (i.e., they can be "nebulized") to be administered via inhalation (e.g., intranasally or intratracheally) (see, Brigham et al., Am. J. Sci., 298:278 (1989)). Aerosol formulations can be placed into pressurized acceptable propellants, such as dichlorodifluoromethane, propane, nitrogen, and the like.

In one embodiment, the siNA molecules of the invention and formulations thereof are administered via pulmonary delivery, such as by inhalation of an aerosol or spray dried formulation administered by an inhalation device or nebulizer, providing rapid local uptake of the nucleic acid molecules into relevant pulmonary tissues. Solid particulate compositions containing respirable dry particles of micronized nucleic acid compositions can be prepared by grinding dried or lyophilized nucleic acid compositions, and then passing the micronized composition through, for example, a 400 mesh screen to break up or separate out large agglomerates. A solid particulate composition comprising the siNA compositions of the invention can optionally contain a dispersant which serves to facilitate the formation of an aerosol as well as other therapeutic compounds. A suitable dispersant is lactose, which can be blended with the nucleic acid compound in any suitable ratio, such as a 1 to 1 ratio by weight.

Spray compositions comprising siNA molecules or compositions of the invention can, for example, be formulated as aqueous solutions or suspensions or as aerosols delivered from pressurized packs, such as a metered dose inhaler, with the use of a suitable liquefied propellant. In one embodiment, aerosol compositions of the invention suitable for inhalation can be either a suspension or a solution and generally contain an siNA molecule comprising formula (A), and a suitable propellant such as a fluorocarbon or hydrogen-containing chlorofluorocarbon or mixtures thereof, particularly hydrofluoroalkanes, especially 1,1,1,2-tetrafluoroethane, 1,1,1,2,3,3,3-heptafluoro-n-propane or a mixture thereof. The aerosol composition can optionally contain additional formulation excipients well known in the art such as surfactants. Non-limiting examples include oleic acid, lecithin or an oligolactic acid or derivative such as those described in WO94/21229 and WO98/34596 and co-solvents for example ethanol. In one embodiment a pharmaceutical aerosol formulation of the invention comprising a compound of the invention and a fluorocarbon or hydrogen-containing chlorofluorocarbon or mixtures thereof as propellant, optionally in combination with a surfactant and/or a co-solvent.

The aerosol formulations of the invention can be buffered by the addition of suitable buffering agents.

Aerosol formulations can include optional additives including preservatives if the formulation is not prepared sterile. Non-limiting examples include, methyl hydroxybenzoate, anti-oxidants, flavorings, volatile oils, buffering agents and emulsifiers and other formulation surfactants. In one embodiment, fluorocarbon or perfluorocarbon carriers are used to reduce degradation and provide safer biocompatible non-liquid particulate suspension compositions of the invention (e.g., siNA and/or LNP formulations thereof). In another embodiment, a device comprising a nebulizer delivers a composition of the invention (e.g., siNA and/or LNP formulations thereof) comprising fluorochemicals that are bacteriostatic thereby decreasing the potential for microbial growth in compatible devices.

Capsules and cartridges comprising the composition of the invention for use in an inhaler or insufflator, of for example gelatin, can be formulated containing a powder mix for inhalation of a compound of the invention and a suitable powder base such as lactose or starch. In one embodiment, each capsule or cartridge contains an siNA molecule comprising formula (A), and one or more excipients. In another embodiment, the compound of the invention can be presented without excipients such as lactose The aerosol compositions of the present invention can be administered into the respiratory system as a formulation including particles of respirable size, e.g. particles of a size sufficiently small to pass through the nose, mouth and larynx upon inhalation and through the bronchi and alveoli of the lungs. In general, respirable particles range from about 0.5 to 10 microns in size. In one embodiment, the particulate range can be from 1 to 5 microns. In another embodiment, the particulate range can be from 2 to 3 microns. Particles of non-respirable size which are included in the aerosol tend to deposit in the throat and be swallowed, and the quantity of non-respirable particles in the aerosol is thus minimized. For nasal administration, a particle size in the range of 10-500 μm is preferred to ensure retention in the nasal cavity.

In some embodiments, an siNA composition of the invention is administered topically to the nose for example, for the treatment of rhinitis, via pressurized aerosol formulations, aqueous formulations administered to the nose by pressurized pump or by nebulization. Suitable formulations contain water as the diluent or carrier for this purpose. In certain embodiments, the aqueous formulations for administration of the composition of the invention to the lung or nose can be provided with conventional excipients such as buffering agents, tonicity modifying agents and the like.

b. Devices

The siNA molecules of the invention can be formulated and delivered as particles and/or aerosols as discussed above and dispensed from various aerosolization devices known by those of skill in the art.

Aerosols of liquid or non-liquid particles comprising an siNA molecule or formulation of the invention can be produced by any suitable means, such as with a device comprising a nebulizer (see for example U.S. Pat. No. 4,501,729) such as ultrasonic or air jet nebulizers.

Solid particle aerosols comprising an siNA molecule or formulation of the invention and surfactant can be produced with any solid particulate aerosol generator. One type of solid particle aerosol generator used with the siNA molecules of the invention is an insufflator. A second type of illustrative aerosol generator comprises a metered dose inhaler ("MDI"). MDIs containing siNA molecules or formulations taught herein can be prepared by methods of the art (for example, see Byron, above and WO96/32099).

The siNA molecules can also be formulated as a fluid formulation for delivery from a fluid dispenser, such as those described and illustrated in WO05/044354.

In certain embodiments of the invention, nebulizer devices are used in applications for conscious, spontaneously breathing subjects, and for controlled ventilated subjects of all ages. The nebulizer devices can be used for targeted topical and systemic drug delivery to the lung. In one embodiment, a device comprising a nebulizer is used to deliver an siNA molecule or formulation of the invention locally to lung or pulmonary tissues. In another embodiment, a device comprising a nebulizer is used to deliver a an siNA molecule or formulation of the invention systemically.

H. Other Applications/Uses of siNA Molecules of the Invention

The siNA molecules of the invention can also be used for diagnostic applications, research applications, and/or manufacture of medicants.

In one aspect, the invention features a method for diagnosing a disease, trait, or condition in a subject comprising administering to the subject a composition of the invention under conditions suitable for the diagnosis of the disease, trait, or condition in the subject.

In one embodiment, siNA molecules of the invention are used to down regulate or inhibit the expression of proteins arising from haplotype polymorphisms that are associated with a trait, disease or condition in a subject or organism. Analysis of genes, or protein or RNA levels can be used to identify subjects with such polymorphisms or those subjects who are at risk of developing traits, conditions, or diseases described herein. These subjects are amenable to treatment, for example, treatment with siNA molecules of the invention and any other composition useful in treating diseases related to target gene expression. As such, analysis of protein or RNA levels can be used to determine treatment type and the course of therapy in treating a subject. Monitoring of protein or RNA levels can be used to predict treatment outcome and to determine the efficacy of compounds and compositions that modulate the level and/or activity of certain peptides and/or proteins associated with a trait, disorder, condition, or disease.

In another embodiment, the invention comprises use of a double-stranded nucleic acid according to the invention for use in the manufacture of a medicament. In an embodiment, the medicament is for use in treating a disease or a condition that is mediated by the action of one or more target genes. In one embodiment, the medicant is for use in treating any disease or condition herein or otherwise known in the art. In some embodiments, the medicament is for use in the treatment of cancer.

In certain embodiments, the siNA molecules of the invention are for use in a method for treating any disease or condition contemplated herein.

In certain embodiments, the siNA molecules of the invention are for use in a method for treating cancer.

I. Examples

The invention will now be illustrated with the following non-limiting examples. Those of skill in the art will readily recognize a variety of non-critical parameters which can be changed or modified to yield essentially the same results.

Example 1: Identification of Highly Potent Stabilized siNA Molecules with Prolonged Duration The development of therapeutic siRNAs with drug-like properties is dependent on the incorporation of chemical modifications to improve duration of RNA knockdown and potency while minimizing non-specific (off-target) effects and stimulation of innate immunity. The growing diversity of siRNA delivery vehicles has expanded beyond traditional lipid encapsulated nano-particles to include dynamic polymer conjugates and conjugation with various targeting ligands including antibodies, sugars, and cholesterol. Many of these delivery strategies expose the siRNA cargo to serum and/or cellular nucleases which can compromise the structural integrity and in vivo efficacy of both unmodified siRNAs and modified siRNAs which have not been optimized for nuclease stability. Additionally, these alternative delivery strategies employ different targeting ligands and mechanisms of endosomal escape, thereby exposing the siRNA cargo to different cellular micro-environments with varied pH and nuclease content. Therefore optimization of siRNA stability is needed for development of therapeutic siRNAs with cross-delivery platform compatibility and potentially enhanced duration due to improvement of stability attributes along with pharmacokinetic and pharmacodynamic profiles of the siRNA molecule.

The modified siNA molecules disclosed herein (see for example sequences described below with reference to particular sequences in Table 1) are shown to significantly improve serum stability while maintaining robust potency. The modification criteria of the present invention can be applied to any siRNA sequence. Furthermore, the presence of 2'-deoxy-2'-fluoro modifications, and in particular 2'-deoxy-2'-fluoro purine modifications in conjunction with 2'-O-methyl pyrimidine modifications, are shown to be important for optimal siRNA duration of knockdown in vivo.

Traditional lipid nanoparticle (LNP) delivery vehicles encapsulate the siRNA and thus limit exposure to serum nucleases upon intravenous dosing of siRNA-LNP complexes in animals. The adoption of alternative delivery platforms such as polymer conjugates (PC) or direct attachment of delivery targeting ligands (e.g., cholesterol) exposes the siRNA molecule to serum nucleases and potentially hostile intracellular environments. Therefore the development of a stabilized siRNAs with strategies that can be applied to siRNA irrespective of sequence to improve nuclease/chemical stability while retaining requisite RNA knockdown and potency is useful in conjunction with heterogeneous delivery vehicle platforms.

The Sci10 Modification Motif

The Stab 07/35 modification motif (see Table 8) is a combination of 2'-deoxy (2'H) purines and 2'-deoxy-2'-fluoro (2'F) pyrimidines on the passenger strand and 2'-O-methyl (2'OMe) purines and 2'-deoxy-2'-fluoro (2'F) purines on the guide strand. When applied to an ApoB (9514) siRNA, the 07/35 motif was shown to have high passenger strand serum stability however the guide strand was susceptible to nuclease degradation (see FIG. 11) in serum. The addition of phosphorothioate linkages at the 3' ends of both strands (07H/35N motif) improved stability. Additional phosphorothioate modification to the 5'-end of the guide strand (motif 07H/35U2) further improved stability. The RNASci10 modification motif represents a departure from the 07/35 modification motif in which purines are 2'F modified and pyrimidines are 2'OMe modified, and position 14 (counting from the 5'-end of the guide strand) of the guide strand is a 2'F nucleotide regardless of underlying purine or pyrimidine identity (see FIG. 11). The Sci10 modification motif shows improved passenger and guide strand stability while retaining in vitro mRNA knockdown and potencies comparable to the 07/35 motif (see FIG. 11 and Table 2).

Position 14 Effects

Position 14 of the guide strand can be sensitive to particular 2'-ribose sugar modifications. An evaluation of 2'F, 2'OMe and 2'H modification of this position was conducted on 7 otherwise unmodified siRNA sequences (see FIG. 12). 2'OMe content at this position was poorly tolerated while 2'H was reasonably tolerated relative to siRNAs unmodified at this position (i.e. 2'OH at position 14). However 2'F was well tolerated and even slightly improved mRNA knockdown was observed relative to unmodified. Therefore, a preferred embodiment of the present invention features a 2'F moiety at position 14 of the guide strand (regardless of underlying pyrimidine or purine identity) of any siNA molecule of the invention (e.g., a siNA molecule having Formula A herein or as described in Table 8).

The ApoB siRNAs described in FIG. 11 were covalently attached to the polymer conjugate via a disulfide linker on the 5' end of the passenger strand and tested for mRNA knockdown in mouse livers in vivo. At day 2 of the in vivo study, ApoB mRNA knockdown by polymer conjugate (PC) Sci10 exceed that measured for the 07/35 motifs tested (FIG. 13A-B, Table 2). The separation of Sci10 from 07/35 chemistries extended at day 7 of the in vivo studies, demonstrating robust duration of mRNA knockdown out to 21 days (FIG. 13B, Table 2).

The Sci10 modification chemistry was also effective when delivered by lipid nanoparticle (LNP) (FIGS. 14A-14B, Table 3) formulations. A third independent in vivo study with PC delivered siRNAs demonstrated certain advantages of the Sci10 motif versus the 07/35 motif (FIG. 14A). However, when delivered with LNP the 07/35 motif is equally effective to Sci10. This can most likely be attributed to the encapsulation of siRNA cargo and protection from serum nucleases noted for the LNP delivery platforms. Also of note is the delivery vehicle-dependent differences in duration of mRNA knockdown at day 7 of the in vivo studies. The PC delivered Sci10 construct is 4-fold more active than either of the LNP delivered siRNAs at the same day 7 time point.

The incorporation of phosphorothioates at positions 1-3 of the guide strand can improve the stability of the guide strand, see for example 07H/35N and 07H/35U2 (FIG. 11). However, each phosphorothioate incorporation can generate mixtures of chiral products and the phosphorothioate modification can be sensitive to oxidative reversion back to a phosphodiester linkage. Therefore an identified set of 2' ribose modifications to positions 1-3 of the guide strand were evaluated for their in vitro stability and mRNA knockdown/potency (FIG. 15 and Table 4). These four modification motifs to the 5' of the guide strand are tolerated, retaining RNA knockdown levels, and have stability profiles equivalent to the phosphorothioates they replace. Therefore these 5'-guide strand 2' ribose modification motifs are preferred because of their ability to replace phosphorothioates while retaining beneficial stability properties. This extends in vivo where the four identified guide strand 5'-end modification motifs have equivalent levels of mRNA knockdown and duration (FIG. 16 and Table 4).

After demonstrating the value of the Sci10 modification motif for ApoB (9514) another siRNA was selected to evaluate whether the Sci10 modification motif could be applied to multiple siRNAs of varying sequence. FIG. 17 shows the in vitro mRNA knockdown and serum stability for a series of SSB (291) siRNAs. As with ApoB, the 07/35-based modification motif had less serum stability. However, the Sci10 modification motif containing phosphorothioates at the 5'-end of the guide was surprising unstable. An inspection of the nucleotide sequence of the 5' guide strand identified a "UA" motif at positions 2-3. This sequence motif is susceptible to nuclease cleavage activity. For example, known sequence preferences of RNase-like activities on RNA templates include UA, CA, UG, and CG motifs that are susceptible to nuclease. Because pyrimidines preceding an adenosine residue appear to be most susceptible, this motif is noted as "YA" in FIG. 17 with "Y" representing pyrimidines. Interestingly, the application of the 2' ribose modification motifs discussed for ApoB (FIG. 15) conferred a striking improvement in the guide strand serum stability of these siRNAs. This observation highlights another liability of using phosphorothioates for serum stability—in the context of nuclease cleavage hotspots phosphorothioates are less effective while 2' ribose modifications confer robust nuclease stability (Table 5). Two of the Sci10 modification motifs (Sci10dfm and Sci10ffd) were selected for in vivo testing (FIG. 18). Compared to the 07/35 modification motif, the two Sci10 with specific 5'-end modification motif selections possess significant RNA knockdown that extends out to 3 weeks in vivo (FIG. 18 and Table 5).

Figure 19C:
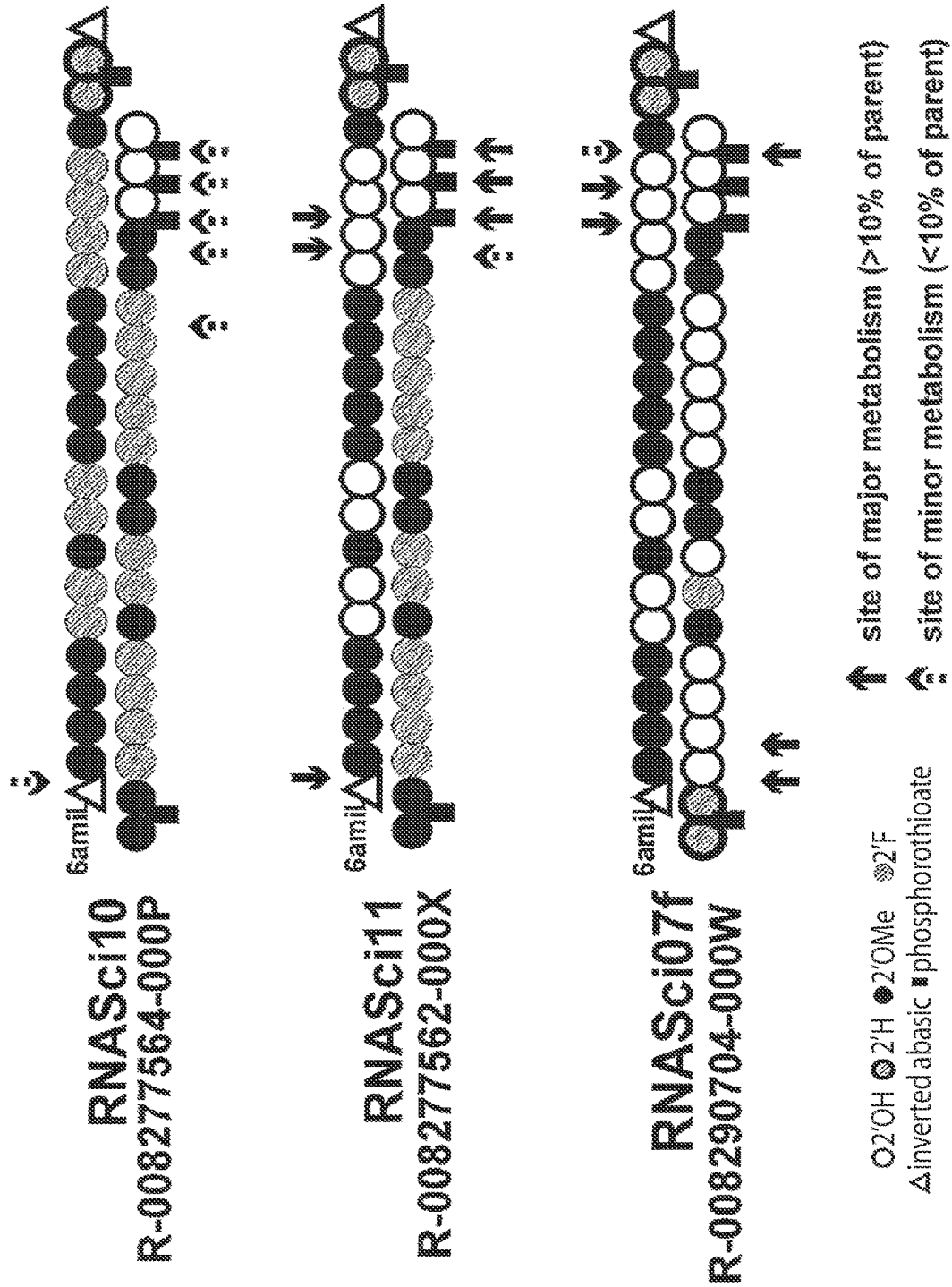

Given the advantageous properties of the Sci10 modification motif, including improved nuclease stability, significant in vivo duration of knockdown and retention of siRNA potency; applicant chose to evaluate the contribution of 2'F purine modifications for ApoB (9514). The Sci11 modification motif removes the 2'F purine modifications from the passenger strand, replacing with 2'OH, while the Sci07f modification motif removes the 2'F purine modification content from both passenger and guide strands. Note that 2'F modification at position 14 of the guide strand is retained. In vitro mRNA knockdown and serum stability was observed to be nearly equivalent among these siRNAs, although the Sci11 motif demonstrated slightly reduced serum stability (FIG. 19A). However, when assessed in vivo, there was a significant and striking separation of these siRNAs (FIG. 19B) in terms of activity. The Sci10 and Sci11 motifs demonstrated equivalent knockdown at day 2 while the Sci07f motif was surprisingly compromised in comparison. As the measurement of duration of ApoB RNA knockdown continued for day 7, 14, and 21 time points, it become clear that the Sci10 motif has superior duration (FIG. 19B and Table 6). Taken together these data suggest that the 2'F purine content on the passenger and guide strand of the Sci10 motif is conferring an advantageous property. To investigate this, the livers from siRNA treated mice were homogenized and mass spectrometry was used to evaluate the in vivo metabolism of the PC-delivered siRNAs (FIG. 19C). The Sci10 siRNA was found to only have minor sites of metabolism-defined as less than 10% of parental strand at 48 hours. When 2'F modified purines are removed from the passenger strand (Sci11) there is a resulting increase in major sites of metabolism on both the passenger and guide strands. Guide strand metabolism can be attributed to loss of the nuclease protective nature of an intact duplex. In other words, a labile passenger strand can exposes the guide strand to nuclease degradation. When 2'F purines are removed from both passenger and guide strands (Sci07f), the in vivo stability of the siRNA is further compromised.

A similar evaluation of 2'F content was extended to SSB (291) siRNAs. The 2'F purines of Sci10dfm and Sci10ffd motifs (see FIGS. 17 and 18) were replaced with 2'OH resulting in Sci07dfm and Sci07ffd siRNAs (FIG. 20A). As with ApoB, the in vitro mRNA knockdown and stability of the Sci07 and Sci10 siRNAs was largely comparable. However, in vivo there was a marked difference in mRNA knockdown and duration between these two motifs (FIG. 20B). The 2'F purine containing Sci10 siRNAs possessed superior initial knockdown which persisted at least 3 weeks in vivo whereas the Sci07 siRNAs without 2'F content had poor initial knockdown and limited duration (Table 7). The SSB (291) recapitulation of the observed ApoB dependence on 2'F content, specifically 2'F purine in combination with 2'OMe pyrimidine modifications, suggests that 2'F content and it's contribution to in vivo duration is a general phenomenon.

A follow-up study evaluated the tolerance of the Sci10 modification motif across 80 different ApoB, SSB, and PHD2 sequences. The Sci10 motif was applied to multiple different target sequences and in vitro knockdown activity was assessed as compared to corresponding minimally modified controls. The minimal modification motif (09H/10N) has ribonucleotides (2'OH) at all positions of the duplex with 2'-OMe uridine overhangs with a single thioate residue between the 2'OMe-U's at the 3' end of each strand. By comparing in vitro knockdown of two different siRNAs (minimally modified 09H/10N versus Sci10) corresponding to the same sequence, the impact of Sci10 modification was assessed on a wide variety of different siRNA sequences. This analysis includes 29 different ApoB sequences, 24 different PHD2 sequences, and 27 different SSB sequences (see Tables 10, 11, and 12 respectively). Knockdown of target mRNA was measured at 10 nM and 1nM concentrations to determine the impact of Sci10 modification on the potency of the tested siRNAs. Comparison of 09H/10N and Sci10 was performed on a pair-wise basis for each of the 80 different siRNA sequences. The difference in knockdown (in log 2) was calculated by subtracting 09H/10N knockdown levels from those measured for the Sci10 motif. Positive values indicate the Sci10 motif is more active than minimally modified 09H/10N; an unexpected result for highly modified siRNAs. Negative values indicate that the Sci10 modification was less active relative to 09H/10N. The experimental variation and accuracy of the qPCR assay is approximately 0.5 (log 2). Therefore values within 0.5 of the 09H/10N are considered to be equivalent in overall knockdown and therefore equally tolerated. This data is summarized in Table 13.

In conclusion, incorporation of 2'OMe pyrimidine and 2'F purine modifications in the passenger and guide strands of siRNAs are shown to demonstrate improved siRNA serum stability. This RNASci10 modification motif improves siRNA stability while retaining potency of RNA knockdown. RNASci10 provides compatibility with RNA delivery vehicles such as polymer conjugates and ligand conjugates where the siRNA is exposed to serum and/or hostile cellular environments. Additionally, this modification motif improves duration of siRNA mediated RNA knockdown in vivo via a mechanism that appears to benefit from the presence of 2'F modifications, specifically 2'F purine combined with 2'OMe pyrimidine modifications. The combination of the RNASci10 modification motif with independently identified modifications to positions 1-3 of the 5'-end of the guide strand results in siRNAs which are 100% modified and possess high stability, potency, and in vivo duration. Because of their inherent nuclease stability, siRNAs containing these modification motifs can be coupled with cell or tissue targeting ligands (e.g. antibodies, sugars or cholesterol) to create effective self-delivering siRNAs.

MATERIALS AND METHODS siNA Synthesis

For each oligonucleotide of a target sequence, the two individual, complementary strands of the siNA were synthesized separately using solid phase synthesis, then purified separately by reversed phase solid phase extraction (SPE). The complementary strands were annealed to form the double strand (duplex) and delivered in the desired concentration and buffer of choice.

Briefly, the single strand oligonucleotides were synthesized using phosphoramidite chemistry on an automated solid-phase synthesizer, using procedures as are generally known in the art (see for example U.S. application Ser. No. 12/064,014). A synthesis column was packed with solid support derivatized with the first nucleoside residue (natural or chemically modified). Synthesis was initiated by detritylation of the acid labile 5'-O-dimethoxytrityl group to release the 5'-hydroxyl. A suitably protected phosphoramidite and a suitable activator in acetonitrile were delivered simultaneously to the synthesis column resulting in coupling of the amidite to the 5'-hydroxyl. The column was then washed with a solvent, such as acetonitrile. An oxidizing solution, such as an iodine solution was pumped through the column to oxidize the phosphite triester linkage P(III) to its phosphotriester P(V) analog. Unreacted 5'-hydroxyl groups were capped using reagents such as acetic anhydride in the presence of 2,6-lutidine and N-methylimidazole. The elongation cycle was resumed with the detritylation step for the next phosphoramidite incorporation. This process was repeated until the desired sequence was synthesized. The synthesis concluded with the final 5'-terminus protecting group (trityl or 5'-O-dimethoxytrityl).

Upon completion of the synthesis, the solid-support and associated oligonucleotide were dried under argon pressure or vacuum. Aqueous base was added and the mixture was heated to effect cleavage of the succinyl linkage, removal of the cyanoethyl phosphate protecting group, and deprotection of the exocyclic amine protection.

The following process was performed on single strands that do not contain ribonucleotides. After treating the solid support with the aqueous base, the mixture was filtered to separate the solid support from the deprotected crude synthesis material. The solid support was then rinsed with water, which is combined with the filtrate. The resultant basic solution allows for retention of the 5'-O-dimethoxytrityl group to remain on the 5' terminal position (trityl-on).

For single strands that contain ribonucleotides, the following process was performed. After treating the solid support with the aqueous base, the mixture was filtered to separate the solid support from the deprotected crude synthesis material. The solid support was then rinsed with dimethylsulfoxide (DMSO), which was combined with the filtrate. Fluoride reagent, such as triethylamine trihydrofluoride, was added to the mixture, and the solution was heated. The reaction was quenched with suitable buffer to provide a solution of crude single strand with the 5'-O-dimethoxytrityl group on the final 5' terminal position.

The trityl-on solution of each crude single strand was purified using chromatographic purification, such as SPE RPC purification. The hydrophobic nature of the trityl group permits stronger retention of the desired full-length oligo than the non-tritylated truncated failure sequences. The failure sequences were selectively washed from the resin with a suitable solvent, such as low percent acetonitrile. Retained oligonucleotides were then detritylated on-column with trifluoroacetic acid to remove the acid-labile trityl group. Residual acid was washed from the column, a salt exchange was performed, and a final desalting of the material commenced. The full-length oligo was recovered in a purified form with an aqueous-organic solvent. The final product was then analyzed for purity (HPLC), identity (Maldi-TOF MS), and yield (UV $A_{260}$). The oligos were dried via lyophilization or vacuum condensation.

Annealing: Based on the analysis of the product, the dried oligos were dissolved in appropriate buffers followed by mixing equal molar amounts (calculated using the theoretical extinction coefficient) of the sense and antisense oligonucleotide strands. The solution was then analyzed for purity of duplex by chromatographic methods and desired final concentration. If the analysis indicated an excess of either strand, then the additional non-excess strand was titrated until duplexing was complete. When analysis indicated that the target product purity has been achieved the material was delivered and ready for use.

Further Synthesis Steps for Commercial Preparations

Once analysis indicates that the target product purity has been achieved after the annealing step, the material is transferred to the tangential flow filtration (TFF) system for concentration and desalting, as opposed to doing this prior to the annealing step.

Ultrafiltration: The annealed product solution is concentrated using a TFF system containing an appropriate molecular weight cut-off membrane. Following concentration, the product solution is desalted via diafiltration using Milli-Q water until the conductivity of the filtrate is that of water.

Lyophilization: The concentrated solution is transferred to a bottle, flash frozen and attached to a lyophilizer. The product is then freeze-dried to a powder. The bottle is removed from the lyophilizer and is now ready for use.

RT-qPCR Assays (Primary Screens and Dose-Response Curves)

Hepa1-6 cells were cultured in Dulbecco's Modified Eagle Medium supplemented with 10% fetal bovine serum, 1% penicillin-steptomycin, and 1% sodium bicarbonate. These cells were plated in a 96-well culture plates at a density of 3000 cells/well 24 hours prior to transfection.

Transfections were performed using Opti-MEM I Reduced Serum Media and Lipofectamine RNAiMAX per the manufacturers' directions. Final siRNA concentrations are 10 nM and InM for primary screens. Final siRNA concentrations for the dose-response curves (ssDRCs) range from 40 nM to 0.002 nM along an 8-point, 4-fold titration curve.

Twenty-four hours post-transfection cells were washed with phosphate-buffered saline and processed using the TaqMan Gene Expression Cells-to-CT™ Kit, per manufacturer's instructions, to extract RNA, synthesize cDNA, and perform RT-qPCR using an SSB or ApoB specific Taqman primer/probe set on an ABI Prism 7900HT Sequence Detector.

Reverse transcription conditions were as follows: 60 minutes at 37° C. followed by 5 minutes at 95° C. RT-qPCR conditions were as follows: 2 minutes at 50° C., 10 minutes at 95° C., followed by 40 cycles of 15 seconds at 95° C. and 1 minute at 60° C. GAPDH mRNA levels were used for data normalization. Knockdown of SSB/ApoB was calculated as the two-fold change in SSB/ApoB cDNA measured in experimentally-treated cells relative to the SSB/ApoB cDNA measured in non-targeting, control-treated cells.

In Vitro Stability Assays

20 µg/mL siNA was incubated with C57/BL6 mouse serum at 37° C. At 0, 2, and/or 4 hours an aliquot of serum/siNA sample was combined with an equal volume of lysis-loading buffer (a proprietary buffer supplied by vendor containing 2M urea. For siNAs with multiple phosphorothioates, lysis-loading buffer was supplemented with 10 mM DTT or 5 mM cysteine and TCEP to prevent oxygen replacement during the purification process) and mixed to quench the digestion. All quenched samples were incubated on ice and an internal standard was added to control for variability during the solid phase extraction (SPE) step.

SPE on lysis/siNA/serum samples was performed using 96-well Phenomenex Solid Phase Extraction plates containing 100 mg polymeric sorbent. Unless otherwise indicated, all SPE steps were performed using a vacuum setting of ~3" Hg. The SPE wells were first conditioned with 1 mL methanol, then equilibrated with 1 mL of equilibration buffer (50 mM $NaH_2PO_4$/2 mM $NaN_3$, pH 5.5). Next, the lysis siNA/serum samples were loaded onto the plate at a flow rate less than 1 mL/minute. After the samples were loaded, the vacuum was increased to ~10" Hg briefly to completely evacuate the loading solution from the wells. The wells were then washed six times with 1 mL of wash buffer (50 mM $NaH_2PO_4$/Acetonitrile, pH 5.5). Following the final wash the vacuum was increased to 15" Hg for one minute to remove excess wash buffer. Next, samples were eluted into a sample collection tubes using 1 mL of wash buffer (100 mM NH₄HCO₄/10% THF/40% Acetonitrile, pH 8.8) per sample. After elution, samples were sealed with Airpore sealing tape and frozen on dry ice. Once frozen, samples were lyophilized overnight and stored at −20° C. until LC-MS analysis.

Lyophilized samples were reconstituted using 150 µL of 1 mM EDTA and briefly vortexed. Reconstituted samples were then used to make 1:5 dilutions in V-bottom MS 96-well plates using 1 mM. LC-MS analysis was performed using these 1:5 dilutions and a 10 µL injection volume.

LC MS Analysis

Ion-pair reversed phase HPLC chromatographic separations were performed on a Thermo Hypersil Gold 30×2 mm C18 3µ particle size column at a flow rate of 400 □L/min. Mobile phase A consisted of 1.7 mM TEA and 100 mM HFIP (pH 7.5) in water, and mobile phase B was methanol:acetonitrile (90:10). A 10-20 □L injection of each sample was loaded onto the column and separated using the following elution gradient: 5% B for one minute, 5% to 25% B over two minutes, 90% B for one minute followed by initial conditions for two minutes for column re-equilibration.

Mass spectrometry was performed with a Thermo LTQ-Orbitrap XL or Exactive Orbitrap system equipped with an electrospray ionization source and operating in the negative-ion mode, a MichromBioresources MSD4 HPLC pump, a Leap Technologies HTS PAL autosampler and a column heater operated at 70° C. Data acquisition was performed with Thermo Excalibur software and data analysis was processed with in-house custom designed software.

Calculations

The expression level of the gene of interest and % inhibition of gene expression (% KD) was calculated using Comparative Ct method:

$$dCt = Ct_{Target} - Ct_{GAPDH}$$

$$ddCt(\text{log2fold change}) = dCt_{(Target\ siNA)} - dCt_{(NTC)}$$

$$\text{Relative expression level} = 2^{-ddCt}$$

$$\% \ KD = 100 \times (1 - 2^{-ddCt})$$

The non-targeting control siNA was, unless otherwise indicated, chosen as the value against which to calculate the percent inhibition (knockdown) of gene expression, because it is the most relevant control.

Additionally, only normalized data, which reflects the general health of the cell and quality of the RNA extraction, was examined. This was done by looking at the level of two different mRNAs in the treated cells, the first being the target mRNA and the second being the normalized mRNA. This allowed for elimination of siNAs that might be potentially toxic to cells rather than solely knocking down the gene of interest. This was done by comparing the Ct for GAPDH in each well relative to the GAPDH Ct for the entire plate.

In Vivo Knockdown Studies

C57/BL6 mice were dosed with siNA formulated in polymer conjugate or lipid nanoparticle at 3mpk. Animals were sacked at the indicated timepoints and livers were harvested and stored at 4° C. in RNALater until ready for analysis.

Liver tissue was homogenized in Qiazol using stainless steel beads and a Qiagen TissueLyser. Following homogenization, chloroform was added and samples were centrifuged. The aqueous layer was combined with an equal volume of 70% ethanol and samples were purified using a Qiagen RNeasy purification kit per manufacturer's directions. The resulting RNA was then normalized, cDNA was synthesized, and RT-qPCR was performed using SSB or ApoB specific Taqman primer/probe sets on an ABI Prism 7900HT Sequence Detector.

Reverse transcription conditions were as follows: 60 minutes at 37° C. followed by 5 minutes at 95° C. RT-qPCR conditions were as follows: 2 minutes at 50° C., 10 minutes at 95° C., followed by 40 cycles of 15 seconds at 95° C. and 1 minute at 60° C. GAPHD mRNA levels were used for data normalization. Knockdown of SSB/ApoB was calculated as the log 2fold change in SSB/ApoB cDNA measured in experimentally-treated cells relative to the SSB/ApoB cDNA measured in non-targeting, control-treated cells.

Synthesis of siNA Polyconjugates

General Polymer Synthesis-Continuous Cationic Polymerization

SCHEME 1

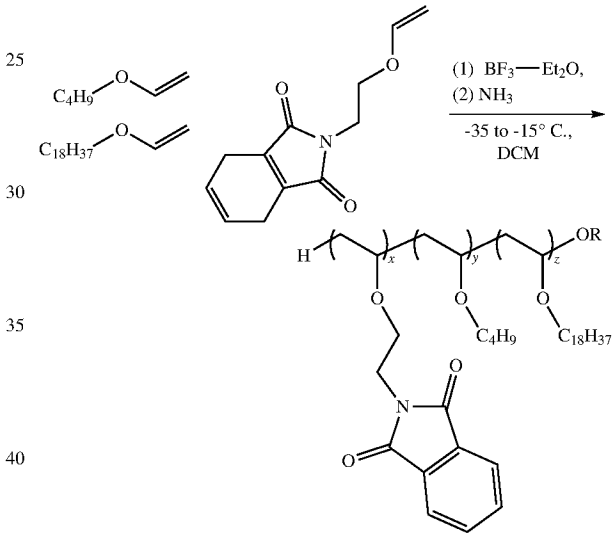

Continuous Synthesis of Vinyl Ether Polymers Using Three Reacting Streams

Stream 1: Octadecyl vinyl ether (6.31 g, 21.27 mmol, 1 eq), n-butyl vinyl ether (8.52, 85.07 mmol, 4 eq) and N-(2-Vinyloxy-ethyl)phthalimide (69.30 g, 319.02 mmol, 15 eq) was dissolved in 900 mL of dichloromethane (150 ml/g octadecyl vinyl ether) at a water content between 50-100 ppm.

Stream 2: Boron trifluoride diethyl etherate (0.92 g, 6.48 mmol, 1.5 mol % vs monomers) was dissolved in 45 mL of dichloromethane.

Stream 3: 2M ammonia in methanol (12.96 mL, 25.91 mmol, 4 eq versus boron trifluoride diethyl etherate) was dissolved in 887 mL of dichloromethane.

Stream 1 was pumped at 1.429 mL/min through ¹⁄₁₆" PTFE and 316 stainless steel tubing introduced to a controlled bath set at −30° C. Stream 2 was pumped at 0.0714 mL/min through ¹⁄₁₆" PTFE and 316 stainless steel tubing introduced to the controlled bath. Streams 1 and 2 are mixed in a 1 mm ID 316 stainless steel tee before entering a 30 mL coil of ⅛" 304 stainless steel tubing. Stream 3 was pumped at 1.429 mL/min through ¹⁄₁₆" PTFE and 316 stainless steel tubing introduced to the controlled bath before mixing with the resulting stream from the 30 mL coil (mixture of Streams 1 and 2) in a 1 mm ID 316 stainless steel tee. The resulting stream exited the controlled bath to a collection vessel. The collected polymer was isolated by removal of dichloromethane under reduced pressure to afford copolymer with a molecular weight of 29.4 kDa (add MW details) and polydispersity index of 2.1.

Polymer Deprotection, Purification and Characterization

SCHEME 2

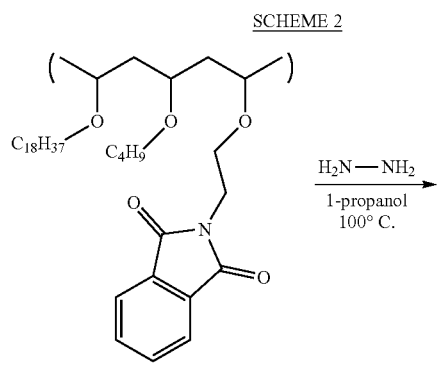

In a 3-neck flask fitted with an overhead stirrer, reflux condensor, and nitrogen inlet was slurried Polymer 1 (50.0 g, 79 mmol) in 2-Propanol (1000 ml). Then charged with hydrazine (25% wt in H$_2$O) (499 ml, 3889 mmol) and heated (65° C.). After 16 hrs, the reaction was cooled to room temperature. A constant volume distillation was performed to remove 2-propanol while adding 0.1 M NaOH to maintain a volume of 1500 mL of total reaction volume. The distillation was continued until amount of 2-propanol remaining in the reaction mixture was below 1 percent of the total volume as monitored by GC. The aqueous polymer solution was then subjected to TFF purification (PALL centremate membrane, 1K MW cutoff, part number) with NaOH (0.25N) until HPLC of solution indicated complete removal of phthalhydrazide. Then used water until pH of waste stream became neutral (pH 7-8). The aqueous solution was then freeze-dried to obtain product (20.3 g) as a sticky oil. Water content of the isolated polymer was determined by TGA. Sodium content of the isolated polymer was determined by ICP-MS. The weight percent of the isolated polymer was determined by subtracting the amount by weight of water and sodium hydroxide.

Synthesis of SATA-siNA
First Conjugation Step

SCHEME 3

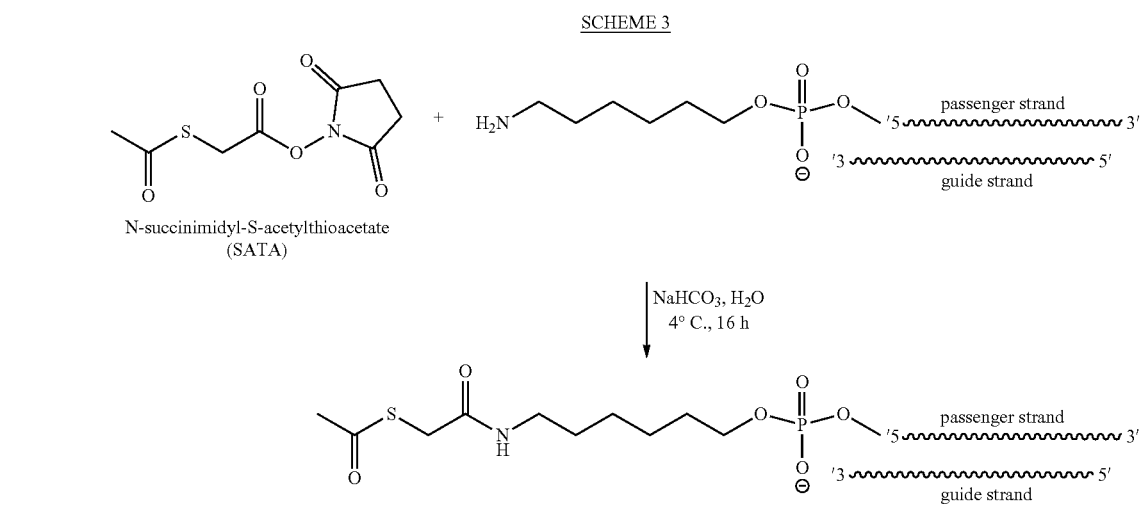

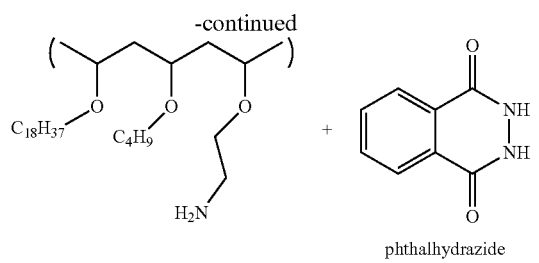

The siNA (1 g, 0.0714 mmol) was dissolved in 0.1M sodium bicarbonate buffer (20 ml, 50 mg/mL) in a vial with magnetic stir bar and cooled to 0-5° C. in an ice water bath. In a separate vial SATA (83 mg, 0.357 mmol, 5 equivalents) was dissolved in 0.78 ml DMSO. The SATA solution was added over 1 min and the clear, colorless reaction mixture stirred at 0-5° C. for 2 h. After 2 h, the reaction mixture was sampled and analyzed by UPLC or HPLC for completion of the conjugation. If greater than 5% siNA remained unreacted, another charge of SATA in DMSO (2.0 equivalents) was added and the reaction aged at 0-5° C. for completion of the SATA conjugation (confirmation by HPLC or UPLC). When there was less than 5% unreacted siNA 1 remaining by UPLC or HPLC, the reaction mixture was purified by TFF (MW cutoff and manufacturer information) dialysis using endonuclease free water until HPLC indicated the removal of N-hydroxysuccinimide, and N-succinimidyl-S-acetylthioacetate. The recovered solution was lyophilized to a white fluffy solid.

Activation Step: Activation of Polymer with SMPT added to a 1 L sterile plastic bottle. To this solution was added SMPT as 1 mg/mL solution in DMSO (18 mg, 1800 µL) corresponding to 1.5 wt % with respect to the polymer weight. The solution was stirred for 1 hr at rt to generate activated polymer. The reaction was monitored for release of N-hydroxy succinimide by HPLC.

SCHEME 4

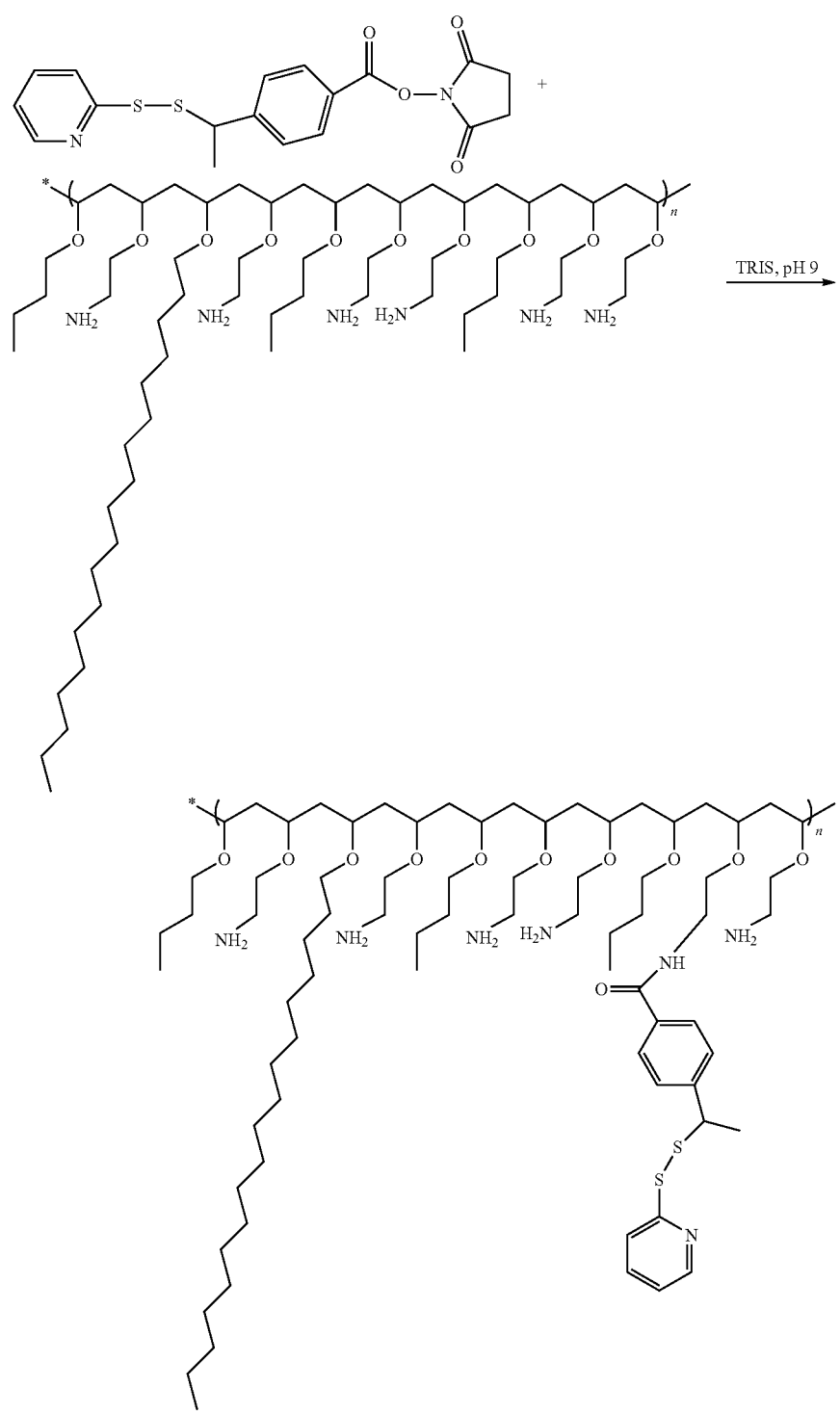

Polymer 1 (1.2 g) in a 40 mL vial was dissolved in 100 mM sterile TRIS buffer at pH 9 (120 mL, 10 mg/mL) and Second Conjugation Step-Conjugation of SATA-siNA to Activated Polymer

SCHEME 5

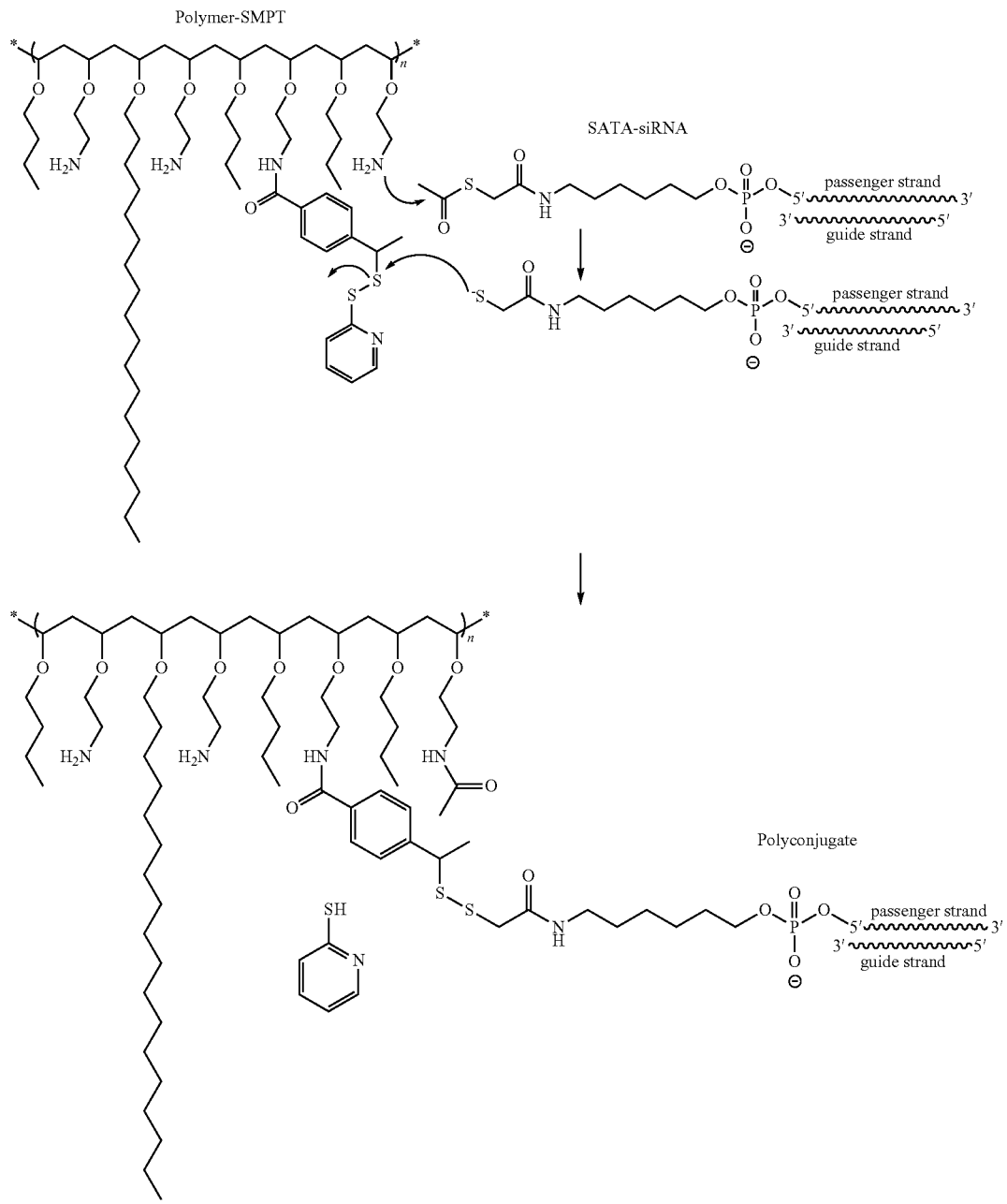

The activated polymer was further diluted using 100 mM sterile TRIS buffer at pH 9 (496 mL), followed by the addition of SATA-modified siNA as a solution in water (250 mg, 32.4 mg/mL, 7716 µL). This solution was aged for 4 hours at room temperature. The reaction was monitored by HPLC for release of 2-thiopyridine.

Masking Step: Formulation of siNA-Polymer Conjugate with Masking Agents

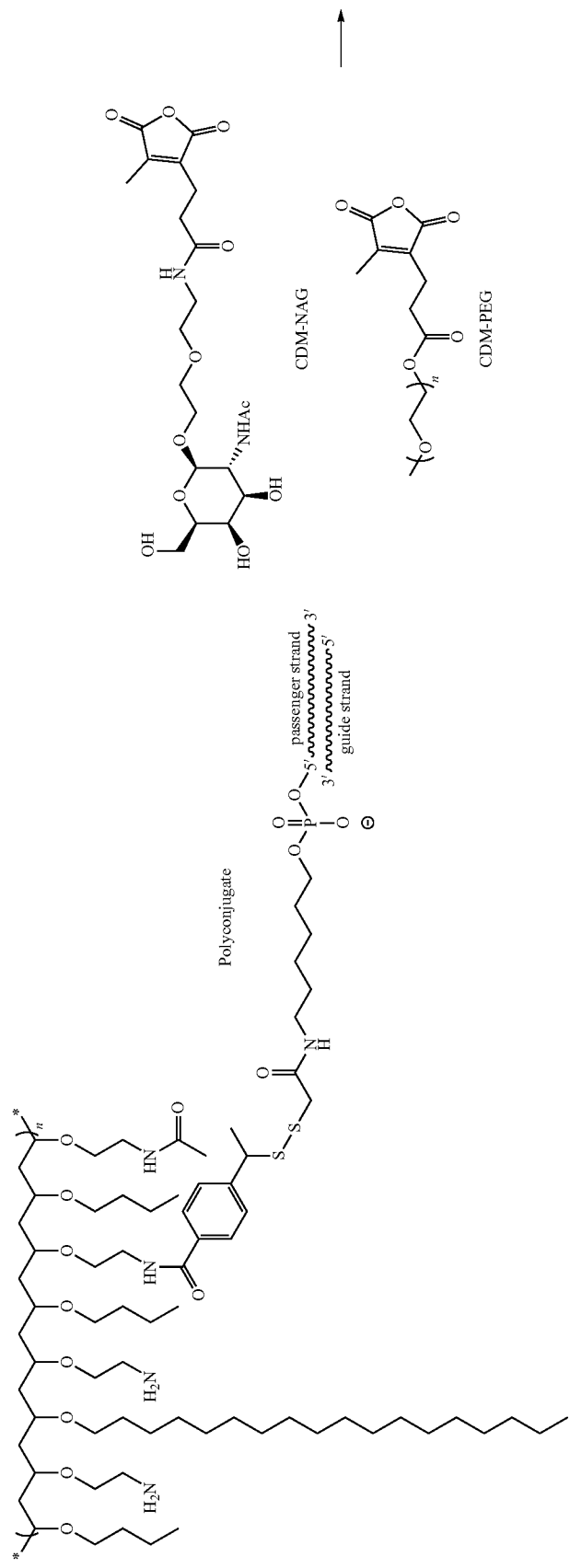

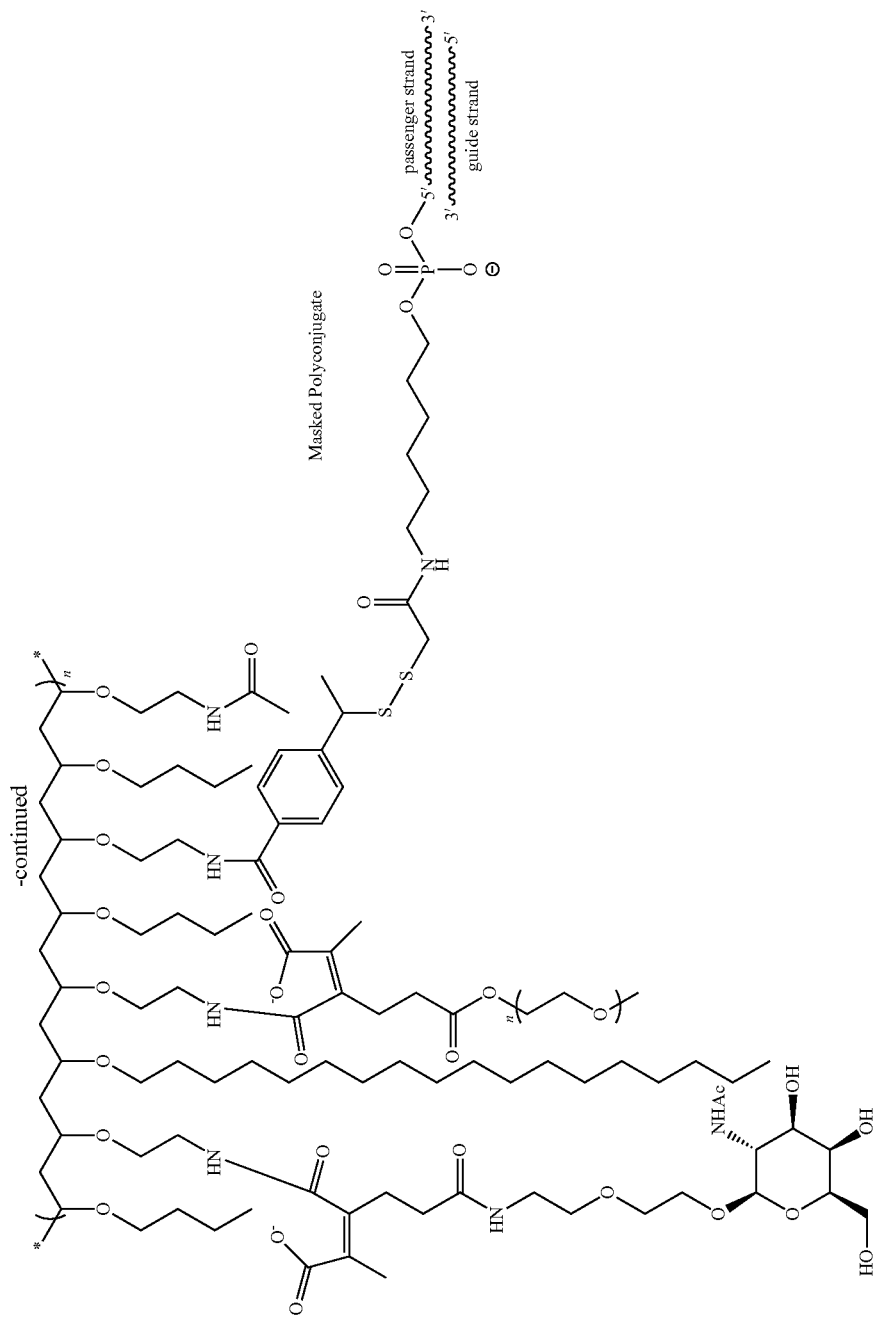

In a separate 1 L sterile plastic bottle, solid CDM-NAG (5.5 g) and CDM-PEG (2.85 g) was added. The siNA-polymer conjugate solution was transferred by pouring into the plastic bottle containing the CDM-NAG and CDM-PEG solids. The mixture was stirred for 2 minutes to dissolve all solids and then transferred by pouring into the original plastic bottle which contained the siNA-polymer conjugate. The reaction was stirred for 1 hour. The pH of the final solution was monitored to ensure the pH was between 8-9. The reaction was monitored by SAX and SEC to visualize the polymer conjugate, and determine the amount of siNA conjugated covalently to the polymer. The amount of CDM-NAG and CDM-PEG was determined by HPLC. The concentration of siNA in solution was determined by ICP-MS, measuring phosphorous concentration.

Example 2: LNP Formulation of siNA

General Process Description for LNP Formulations:

The lipid nanoparticles are prepared by an impinging jet process. The particles are formed by mixing lipids dissolved in alcohol with siNA dissolved in a citrate buffer. The mixing ratio of lipids to siNA is targeted at 45-55% lipid and 65-45% siNA. The lipid solution contains a cationic lipid, a helper lipid (cholesterol), PEG (e.g. PEG-C-DMA, PEG-DMG) lipid, and DSPC at a concentration of 5-15 mg/mL with a target of 9-12 mg/mL in an alcohol (for example ethanol). The ratio of the lipids has a mole percent range of 25-98 for the cationic lipid with a target of 35-65, the helper lipid has a mole percent range from 0-75 with a target of 30-50, the PEG lipid has a mole percent range from 1-15 with a target of 1-6, and the DSPC has a mole percent range of 0-15 with a target of 0-12. The siNA solution contains one or more siNA sequences at a concentration range from 0.3 to 1.0 mg/mL with a target of 0.3-0.9 mg/mL in a sodium citrate buffered salt solution with pH in the range of 3.5-5. The two liquids are heated to a temperature in the range of 15-40° C., targeting 30-40° C., and then mixed in an impinging jet mixer instantly forming the LNP. The teeID has a range from 0.25 to 1.0 mm and a total flow rate from 10-600 mL/minute The combination of flow rate and tubing ID has the effect of controlling the particle size of the LNPs between 30 and 200 nm. The solution is then mixed with a buffered solution at a higher pH with a mixing ratio in the range of 1:1 to 1:3 vol:vol but targeting 1:2 vol:vol. This buffered solution is at a temperature in the range of 15-40° C., targeting 30-40° C. The mixed LNPs are held from 30 minutes to 2 hrs prior to an anion exchange filtration step. The temperature during incubating is in the range of 15-40° C., targeting 30-40° C. After incubating, the solution are filtered through a 0.8 μm filter containing an anion exchange separation step. This process uses tubing IDs ranging from 1 mm ID to 5 mm ID and a flow rate from 10 to 2000 mL/minute The LNPs are concentrated and diafiltered via an ultrafiltration process where the alcohol is removed and the citrate buffer is exchanged for the final buffer solution such as phosphate buffered saline. The ultrafiltration process uses a tangential flow filtration format (TFF). This process uses a membrane nominal molecular weight cutoff range from 30-500 KD. The membrane format is hollow fiber or flat sheet cassette. The TFF processes with the proper molecular weight cutoff retains the LNP in the retentate and the filtrate or permeate contains the alcohol; citrate buffer; and final buffer wastes. The TFF process is a multiple step process with an initial concentration to a siNA concentration of 1-3 mg/mL. Following concentration, the LNPs solution is diafiltered against the final buffer for 10-20 volumes to remove the alcohol and perform buffer exchange. The material is then concentrated an additional 1-3 fold. The final steps of the LNP process are to sterile filter the concentrated LNP solution and vial the product.

Analytical Procedure:

1) siNA Concentration

The siNA duplex concentrations are determined by Strong Anion-Exchange High-Performance Liquid Chromatography (SAX-HPLC) using Waters 2695 Alliance system (Water Corporation, Milford MA) with a 2996 PDA detector. The LNPs, otherwise referred to as RNAi Delivery Vehicles (LNPs), are treated with 0.5% Triton X-100 to free total siNA and analyzed by SAX separation using a Dionex BioLC DNAPac PA 200 (4×250 mm) column with UV detection at 254 nm. Mobile phase is composed of A: 25 mM NaClO$_4$, 10 mM Tris, 20% EtOH, pH 7.0 and B: 250 mM NaClO$_4$, 10 mM Tris, 20% EtOH, pH 7.0 with a liner gradient from 0-15 min and a flow rate of 1 ml/minute. The siNA amount is determined by comparing to the siNA standard curve.

2) Encapsulation Rate

Fluorescence reagent SYBR Gold is employed for RNA quantitation to monitor the encapsulation rate of LNPs. LNPs with or without Triton X-100 are used to determine the free siNA and total siNA amount. The assay is performed using a SpectraMax M5e microplate spectrophotometer from Molecular Devices (Sunnyvale, CA). Samples are excited at 485 nm and fluorescence emission is measured at 530 nm. The siNA amount is determined by comparing to an siNA standard curve.

Encapsulation rate=(1-free siNA/total siNA)×100%

3) Particle Size and Polydispersity

LNPs containing 1 μg siNA are diluted to a final volume of 3 ml with 1×PBS. The particle size and polydispersity of the samples is measured by a dynamic light scattering method using ZetaPALS instrument (Brookhaven Instruments Corporation, Holtsville, NY). The scattered intensity is measured with He—Ne laser at 25° C. with a scattering angle of 90°.

4) Zeta Potential Analysis

LNPs containing 1 μg siNA are diluted to a final volume of 2 ml with 1 mM Tris buffer (pH 7.4). Electrophoretic mobility of samples is determined using ZetaPALS instrument (Brookhaven Instruments Corporation, Holtsville, NY) with electrode and He—Ne laser as a light source. The Smoluchowski limit is assumed in the calculation of zeta potentials.

5) Lipid Analysis

Individual lipid concentrations are determined by Reverse Phase High-Performance Liquid Chromatography (RP-HPLC) using Waters 2695 Alliance system (Water Corporation, Milford MA) with a Corona charged aerosol detector (CAD) (ESA Biosciences, Inc, Chelmsford, MA). Individual lipids in LNPs are analyzed using an Agilent Zorbax SB-C18 (50× 4.6 mm, 1.8 μm particle size) column with CAD at 60° C. The mobile phase is composed of A: 0.1% TFA in H$_2$O and B: 0.1% TFA in IPA. The gradient changes from 60% mobile phase A and 40% mobile phase B from time 0 to 40% mobile phase A and 60% mobile phase B at 1.00 min; 40% mobile phase A and 60% mobile phase B from 1.00 to 5.00 min; 40% mobile phase A and 60% mobile phase B from 5.00 min to 25% mobile phase A and 75% mobile phase B at 10.00 min; 25% mobile phase A and 75% mobile phase B from 10.00 min to 5% mobile phase A and 95% mobile phase B at 15.00 min; and 5% mobile phase A and 95% mobile phase B from 15.00 to 60% mobile phase A and 40% mobile phase B at 20.00 min with a flow rate of 1 ml/minute. The individual lipid concentration is determined by comparing to the standard curve with all the lipid components in the LNPs with a quadratic curve fit. The molar percentage of each lipid is calculated based on its molecular weight.

General Formulation Procedure for CLinDMA Cholesterol PEG-DMG at a Ratio of 71.9:20.2:7.9

Certain siNA solutions were prepared by dissolving siNAs in 25 mM citrate buffer (pH 4.0) at a concentration of 0.8 mg/mL. Lipid solutions were prepared by dissolving a mixture of 2S-Octyl-ClinDMA, cholesterol and PEG-DMG at a ratio of 71.9:20.2:7.9 in absolute ethanol at a concentration of about 10 mg/mL. Equal volume of siNA and lipid solutions were delivered with two syringe pumps at the same flow rates to a mixing T connector. The resulting milky mixture was collected in a sterile bottle. This mixture was then diluted slowly with an equal volume of citrate buffer, and filtered through a size exclusion hollow fiber cartridge to remove any free siNA in the mixture. Ultra filtration against citrate buffer (pH 4.0) was employed to remove ethanol (test stick from ALCO screen), and against PBS (pH 7.4) to exchange buffer. The final LNP was obtained by concentrating to a desired volume and sterile filtered through a 0.2 mm filter. The obtained LNPs were characterized in term of particle size, alcohol content, total lipid content, nucleic acid encapsulated, and total nucleic acid concentration.

General LNP Preparation For Various Formulations in Table 18 siNA nanoparticle suspensions in Table 18 are prepared by dissolving siNAs and/or carrier molecules in 20 mM sodium citrate buffer (pH 5.0) at a concentration of about 0.40 mg/mL. Lipid solutions are prepared by dissolving a mixture of cationic lipid (e.g., (13Z,16Z)—N,N-dimethyl-3-nonyldocosa-13,16-dien-1-amine, see structure in Table 19), DSPC, Cholesterol, and PEG-DMG (ratios shown in Table 18) in absolute ethanol at a concentration of about 8 mg/mL. The nitrogen to phosphate ratio was approximated to 6:1.

Nearly equal volumes of siNA/carrier and lipid solutions are delivered with two FPLC pumps at the same flow rates to a mixing T connector. A back pressure valve wais used to adjust to the desired particle size. The resulting milky mixture is collected in a sterile glass bottle. This mixture is then diluted with an equal volume of citrate buffer, followed by equal volume of PBS (pH 7.4), and filtered through an ion-exchange membrane to remove any free siNA/carrier in the mixture. Ultra filtration against PBS (7.4) was employed to remove ethanol and to exchange buffer. The final LNP is obtained by concentrating to the desired volume and sterile filtering through a 0.2 μm filter. The obtained LNPs are characterized in terms of particle size, Zeta potential, alcohol content, total lipid content, nucleic acid encapsulated, and total nucleic acid concentration.

LNP Manufacture Process

In a non-limiting example, LNPs are prepared in bulk as follows. The process consists of (1) preparing a lipid solution; (2) preparing an siNA/carrier solution; (3) mixing/particle formation; (4) incubation; (5) dilution; (6) ultrafiltration and concentration.

1. Preparation of Lipid Solution

2 L glass reagent bottles and measuring cylinders are depyrogenated. The lipids are warmed to room temperature. Into the glass reagent bottle is transferred 8.0 g of (13Z, 16Z)—N,N-dimethyl-3-nonyldocosa-13,16-dien-1-amine with a pipette and 1.2 g of DSPC, 3.5 g of Cholesterol, 0.9 g of PEG-DMG were added. To the mixture is added 1 L of ethanol. The reagent bottle is placed in heated water bath, at a temperature not exceeding 50° C. The lipid suspension is stirred with a stir bar. A thermocouple probe is put into the suspension through one neck of the round bottom flask with a sealed adapter. The suspension is heated at 30-40° C. until it became clear. The solution is allowed to cool to room temperature.

2. Preparation of siNA/Carrier Solution

Into a sterile container (Corning storage bottle) is weighed 0.4 g times the water correction factor (approximately 1.2) of siNA powder. The siNA is transferred to a depyrogenated 2 L glass reagent bottle. The weighing container is rinsed 3× with citrate buffer (20 mM, pH 5.0) and the rinses are placed into the 2 L glass bottle, QS with citrate buffer to 1 L. The concentration of the siNA solution is determined with a UV spectrometer using the following procedure. 20 μL is removed from the solution, diluted 50 times to 1000 μL, and the UV reading recorded at $A_{260}$ nm after blanking with citrate buffer. This is repeated. Note, if the readings for the two samples are consistent, an average can be taken and the concentration calculated based on the extinction coefficients of the siNAs. If the final concentration is out of the range of 0.40±0.01 mg/mL, the concentration can be adjusted by adding more siNA/carrier powder, or adding more citrate buffer. This process can be repeated for the second siNA, if applicable When the siNA/carrier solution comprised a single siNA duplex instead of a cocktail of two or more siNA duplexes and/or carriers, then the siNA/carrier was dissolved in 20 mM citrate buffer (pH 5.0) to give a final concentration of 0.4 mg/mL.

The lipid and ethanol solutions are then sterile filtered through a Pall Acropak 20 0.8/0.2 μm sterile filter PN 12203 into a depyrogenated glass vessel using a Master Flex Peristaltic Pump Model 7520-40 to provide a sterile starting material for the encapsulation process. The filtration process is run at an 80 mL scale with a membrane area of 20 cm². The flow rate was 280 mL/minute. This process can be scaled by increasing the tubing diameter and the filtration area.

3. Particle Formation-Mixing Step

Using a two-barrel syringe driven pump (Harvard 33 Twin Syringe), the sterile lipid/ethanol solution and the sterile siNA/carrier or siNA/carrier cocktail/citrate buffer (20 mM citrate buffer, pH 5.0) solutions are mixed in a 0.5 mm ID T-mixer (Mixing Stage I) at equal, or nearly equal, flow rates. The resulting outlet LNP suspension contained 40-50 vol % ethanol. To obtain a 45 vol % ethanol outlet suspension, the sterile lipid/ethanol and the sterile siNA/carrier or siNA/carrier cocktail/citrate buffer solutions are mixed at flow rates of 54 mL/min and 66 mL/min, respectively, such that the total flow rate of the mixing outlet is 120 mL/min.

4. Dilution

The outlet stream of Mixing Stage I is fed directly into a 4 mm ID T-mixer (Mixing Stage II), where it is diluted with a buffered solution at higher pH (20 mM sodium citrate, 300 mM sodium chloride, pH 6.0) at a ratio of 1:1 vol:vol %. This buffered solution is at a temperature in the range of 30-40° C., and is delivered to the 4 mm T-mixer via a peristaltic pump (Cole Parmer MasterFlex L/S 600 RPM) at a flow rate of 120 mL/min.

The outlet stream of Mixing Stage II is fed directly into a 6 mm ID T-mixer (Mixing Stage III), where it is diluted with a buffered solution at higher pH (PBS, pH 7.4) at a ratio of 1:1 vol:vol %. This buffered solution is at a temperature in the range of 15-25° C., and is delivered to the 6 mm T-mixer via peristaltic pump (Cole Parmer MasterFlex L/S 600 RPM) at a flow rate of 240 mL/min.

5. Incubation and Free siNA Removal

The outlet stream of Mixing Stage III is held after mixing for 30 minute incubation. The incubation is conducted at temperature of 35-40° C. and the in-process suspension is protected from light. Following incubation, free (un-encapsulated) siNA is removed via anion exchange with Mustang Q chromatography filters (capsules). Prior to use, the chromatography filters are pre-treated sequentially with flushes of IN NaOH, 1M NaCl, and a final solution of 12.5 vol % ethanol in PBS. The pH of the final flush is checked to ensure pH<8. The incubated LNP stream is then filtered via Mustang Q filters via peristaltic pump (Cole Parmer MasterFlex L/S 600 RPM) at flow rate of approximately 100 mL/min. The filtered stream is received into a sterile glass container for ultrafiltration and concentration as follows.

6. Ultrafiltration, Concentration and Sterile Filtration

The ultrafiltration process is a timed process and the flow rates must be monitored carefully. This is a two step process; the first is a concentration step taking the diluted material and concentrating approximately 8-fold, to a concentration of approximately 0.3-0.6 mg/mL siNA.

In the first step, a ring-stand with a ultrafiltration membrane 100 kDa PES (Spectrum Labs) installed is attached to a peristaltic pump (Spectrum KrosFloII System). 9.2 L of sterile distilled water is added to the reservoir; 3 L is drained to waste and the remainder is drained through permeate to waste. 5.3 L of 0.25N sodium hydroxide is added to the reservoir with 1.5 L drained to waste and 3.1 L drained through permeate to waste. The remaining sodium hydroxide is held in the system for sanitization (at least 10 minutes), and then the pump is drained. 9.2 L of 70 (v/v) % isopropyl alcohol is added to the reservoir with 1.5 L drained to waste and the remainder drained through permeate to waste. 6 L of conditioning buffer (12.5% ethanol in phosphate buffered saline) is added with 1.5 L drained to waste and the remainder drained though the permeate until the waste is of neutral pH (7-8). A membrane flux value is recorded, and the pump was then drained.

The diluted LNP solution is placed into the reservoir to the 1.1 L mark. The pump is turned on at 2.3 L/min. After 5 minutes of recirculation, the permeate pump is turned on at 62.5 mL/min and the liquid level is constant at approximately 950 mL in the reservoir. The diluted LNP solution is concentrated from 9.8 L to 1.1 L in 140 minutes, and the pump is paused when all the diluted LNP solution has been transferred to the reservoir.

The second step is a diafiltration step exchanging the ethanol/aqueous buffer to phosphate buffered saline. During this step, approximately 10-20 diafiltration volumes of phosphate buffered saline are used. Following diafiltration, a second concentration is undertaken to concentrate the LNP suspension 3-fold to approximately 1-1.5 mg/mL siRNA. The concentrated suspension is collected into sterile, plastic PETG bottles. The final suspension is then filtered sequentially via Pall 0.45 µm PES and Pall 0.2 µm PES filters for terminal sterilization prior to vial filling.

The obtained LNPs are characterized in terms of particle size, Zeta potential, alcohol content, total lipid content, nucleic acid encapsulated, and total nucleic acid concentration.

Synthesis of Novel Cationic Lipids

Synthesis of novel cationic lipids of the invention is a linear process starting from lipid acid (i). Coupling to N,O-dimethyl hydroxylamine gives the Weinreb amide ii. Grignard addition generates ketone iii. Titanium mediated reductive amination gives final products of type iv.

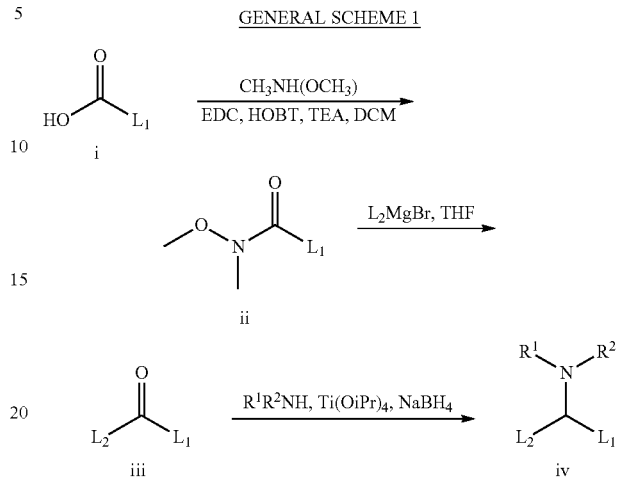

GENERAL SCHEME 1

Synthesis of the single carbon homologated cationic lipids v is a linear process starting from lipid ketone (iii). Conversion of the ketone to the nitrile (iv) is accomplished via treatment with TOSMIC and potassium tert-butoxide. Reduction of the nitrile to the primary amine followed by reductive amination provides final cationic lipids v.

GENERAL SCHEME 2

Synthesis of two carbon homologated cationic lipids viii is a linear process starting from lipid ketone (iii). Conversion of the ketone to the α,β-unsaturated amide vi is accomplished under Peterson conditions. Conjugate reduction of the α,β-unsaturation is performed using LS-Selectride to give amide vii. Reduction of the amide with lithium aluminum hydride provides final cationic lipids viii.

GENERAL SCHEME 3

GENERAL SCHEME 5

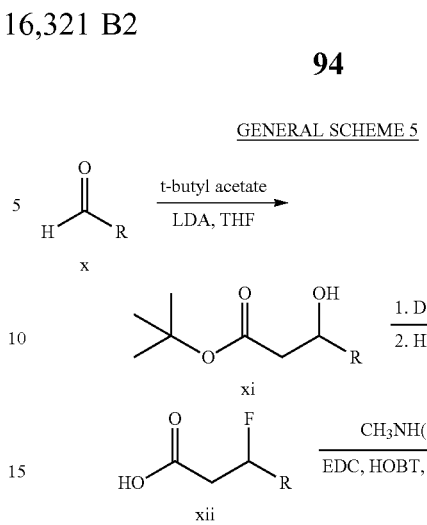

Cyclopropyl containing lipids are prepared according to General Scheme 4. Unsaturated Weinreb amides ii are subjected to Simmons-Smith cyclopropanation conditions to give cyclopropyl containing Weinreb amides ix. These are carried on to final products as outlined in General Schemes 1-3.

GENERAL SCHEME 4

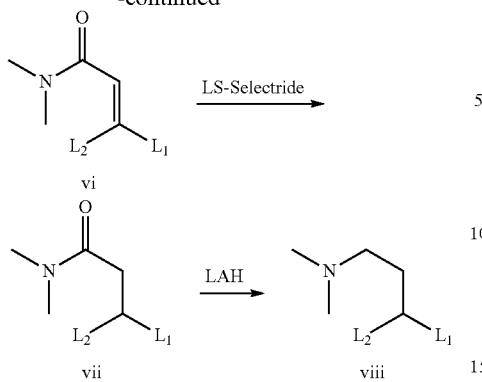

Synthesis of allylic amine cationic lipids xv is a linear process starting with aldehyde x. Addition of t-butyl aceate generates β-hydroxy ester xi. Conversion of the hydroxyl functionality to a fluoro group followed by acid treatment generates β-fluoro acid xii. Conversion of the acid to the Weinreb amide followed by Grignard addition gives the β-fluoro ketone xiv. Reductive amination results in simultaneous elimination to generate the desired allylic amine xv.

20,23-nonacosadien-10-amine, N,N-dimethyl-, (20Z,23Z) (Compound 1)

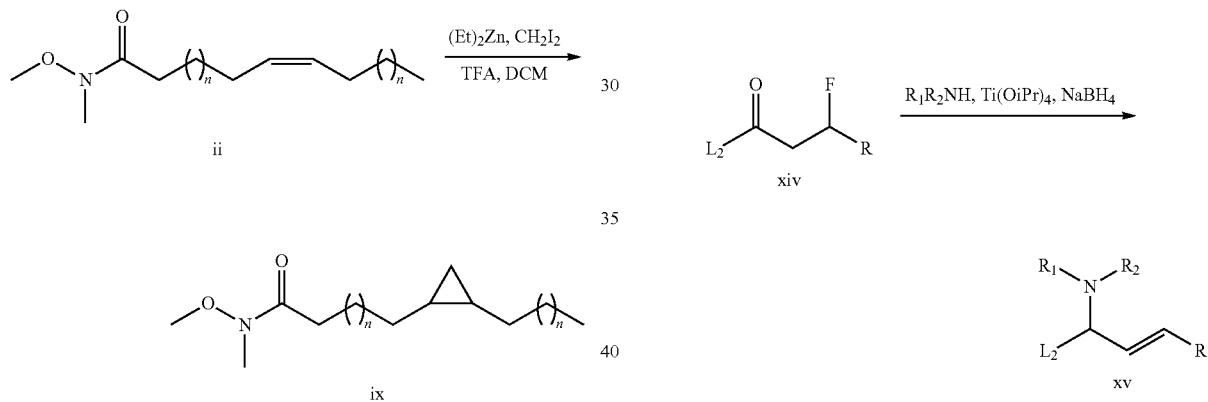

11,14-Eicosadienoic acid, (11Z,14Z)-(50 g, 162 mmol), N,O-Dimethylhydroxylamine hydrochloride (31.6 g, 324 mmol), HOAt (44.1 g, 324 mmol), Et$_3$N (45.2 mL, 324 mmol), and EDC (62.1 g, 324 mmol) were mixed in DCM (810 mL) and stirred overnight at ambient temperature. Reaction was then washed 5×700 mL water, then washed 1×600 mL 1 M NaOH, dried with sodium sulfate, filtered through celite and evaporated to obtain 53.06 g (93%) 11,14-eicosadienamide, N-methoxy-N-methyl-, (11Z,14Z) as a clear golden oil. $^1$H NMR (400 MHZ, CDCl$_3$) δ 5.35 (m, 4H), 3.68 (s, 3H), 3.18 (s, 3H), 2.77 (m, 2H), 2.41 (t, J=7 Hz, 2H), 2.05 (m, 4H), 1.63 (m, 2H), 1.40-1.26 (m, 18H), 0.89 (t, J=7 Hz, 3H).

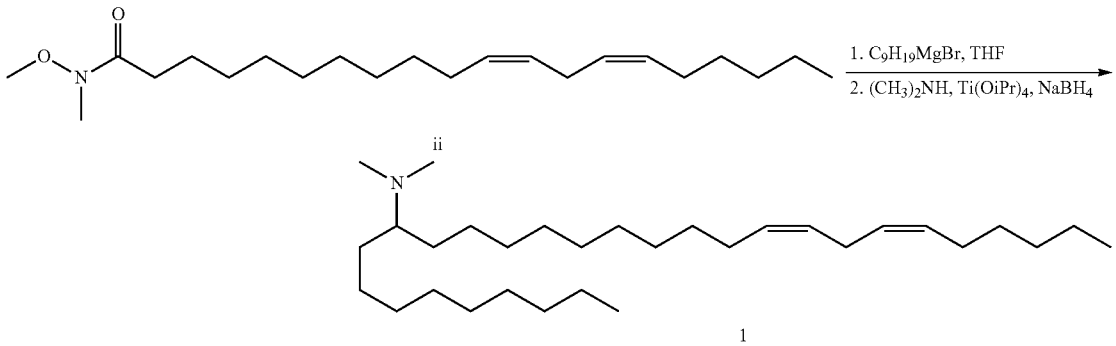

11,14-eicosadienamide, N-methoxy-N-methyl-, (11Z, 14Z)-1 (4 g, 11.38 mmol) was dissolved in dry THF (50.0 ml) in a 250 mL flask then 1 M nonylmagnesium bromide (22.76 ml, 22.76 mmol) was added under nitrogen at ambient temperature. After 10 min, the reaction was slowly quenched with excess sat. aq NH$_4$Cl. The reaction was washed into a separatory funnel with hexane and water, shaken, the lower aqueous layer discarded, the upper layer dried with sodium sulfate, filtered, and evaporated to give crude ketone as a golden oil. To the above crude ketone was added dimethylamine (2 M in THF) (14.22 ml, 28.4 mmol) followed by Ti(O-i-Pr)$_4$ (6.67 ml, 22.76 mmol) and let stir overnight. The next day, added EtOH (50 ml) followed by NaBH$_4$ (0.646 g, 17.07 mmol). After 5 min of stirring, directly injected entire reaction onto a 40 g silica column that was in line with a 330 g silica column. Eluted 10 min 100% DCM, then 30 min 0-15% MeOH/DCM, collected 20,23-nonacosadien-10-amine, N,N-dimethyl-, (20Z,23Z) (1) (2.45 g, 5.47 mmol, 48.1% yield) as a faintly golden oil. $^1$H NMR (400 MHZ, CDCl$_3$) δ 5.35 (m, 4H), 2.78 (m, 2H), 2.23 (m, $^1$H), 2.21 (s, 6H), 2.05 (m, 4H), 1.45-1.16 (m, 38H), 0.89 (m, 6H). HRMS calcd for C31H61N; 448.4877. found 448.4872.

Compounds 2-30 are novel cationic lipids and were prepared according to the General Scheme 1 above.

| Compound | Structure | HRMS |
| --- | --- | --- |
| 2 | | calcd C28H56N 406.4407, found 406.4405. |
| 3 | | calcd C27H54N 392.4251, found 392.4250. |

| Compound | Structure | HRMS |
|---|---|---|
| 4 | | calcd C24H48N 350.3781, found 350.3770. |
| 5 | | calcd C23H46N 336.3625, found 336.3613. |
| 6 | | calcd C25H50N 364.3938, found 364.3941. |
| 7 | | calcd C26H52N 378.4094, found 378.4081. |
| 8 | | calcd C29H58N 420.4564, found 420.4562. |
| 9 | | calcd C26H52N 378.4094, found 378.4089. |
| 10 | | calcd C25H50N 364.3938, found 364.3931. |
| 11 | | calcd C30H60N 434.4720, found 434.4717. |
| 12 | | calcd C29H58N 420.4564, found 420.4561. |

-continued

| Compound | Structure | HRMS |
|---|---|---|
| 13 | | calcd C28H56N 406.4407, found 406.4404. |
| 14 | | calcd C27H54N 392.4251, found 392.4245. |
| 15 | | calcd C33H66N 476.5190, found 476.5196. |
| 16 | | calcd C32H64N 462.5033, found 462.5045. |
| 17 | | calcd C29H59N 422.4720, found 422.4726. |
| 18 | | calcd C28H57N 408.4564, found 408.4570. |
| 19 | | calcd C30H59N 434.4720, found 434.4729. |
| 20 | | calcd C29H61N 424.4877, found 424.4875. |
| 21 | | calcd C32H64N 462.5033, found 462.5023. |

-continued
| Compound | Structure | HRMS |
|---|---|---|
| 22 | 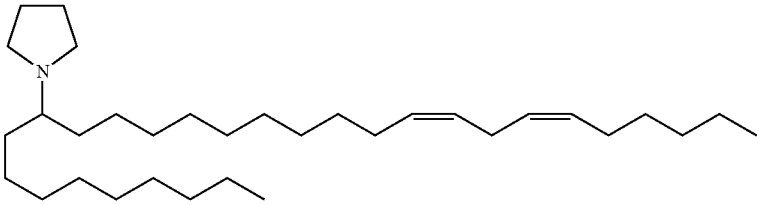 [SMILES: CCCCC/C=C\C/C=C\CCCCCCCCCC(CCCCCCCCC)N1CCCC1] | calcd C33H64N 474.5033, found 474.5033. |
| 23 | 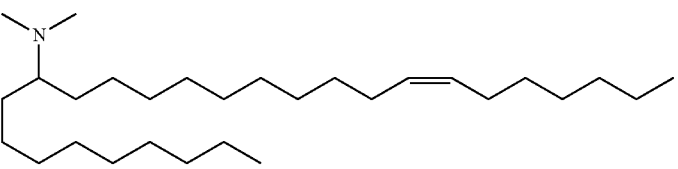 [SMILES: CCCCCC/C=C\CCCCCCCCCC(CCCCCCCCC)N(C)C] | calcd C29H60N 422.4720, found 422.4716. |
| 24 | 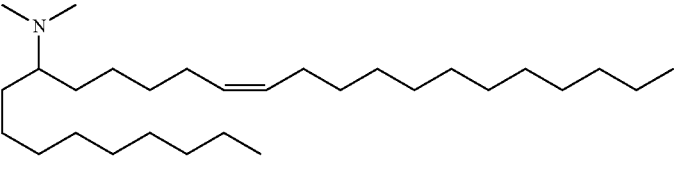 [SMILES: CCCCCCCCCCC/C=C\CCCCC(CCCCCCCCC)N(C)C] | calcd C29H60N 422.4720, found 422.4718. |
| 25 | 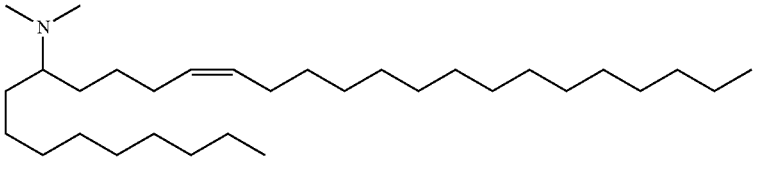 [SMILES: CCCCCCCCCCCCCC/C=C\CCCC(CCCCCCCCC)N(C)C] | calcd C31H64N 450.5033, found 450.5031. |
| 26 | 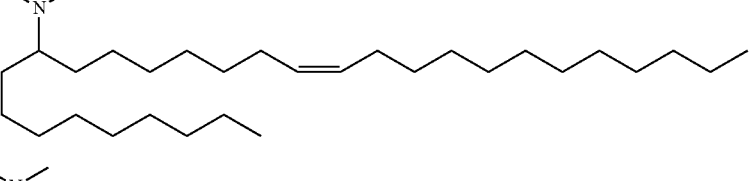 | calcd C31H64N 450.5033, found 450.5034. |
| 27 | 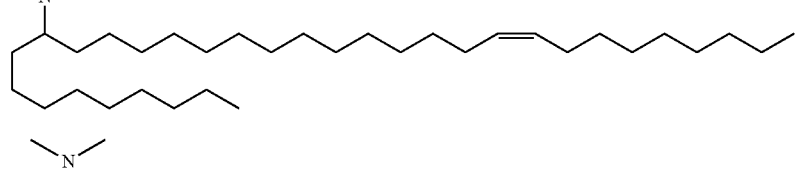 | calcd C35H72N 506.5659, found 506.5635. |
| 28 | 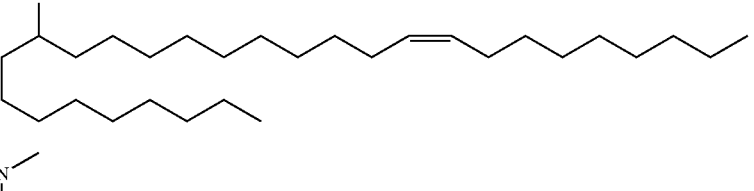 | calcd C31H64N 450.5033, found 450.5037. |
| 29 | 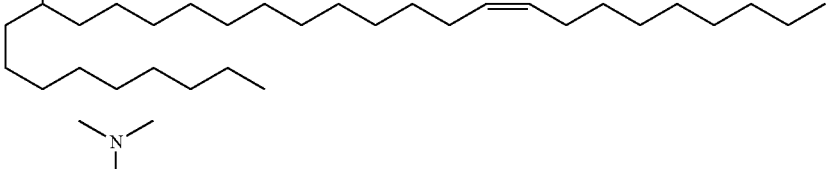 | calcd C33H68N 478.5346, found 478.5358. |
| 30 | 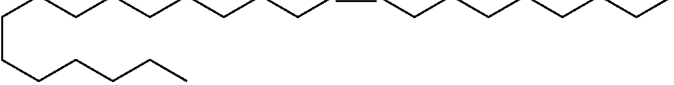 | calcd C27H56N 394.4407, found 394.4407. |

(12Z,15Z)—N,N-Dimethyl-2-Nonylhenicosa-12,15-Dien-1-Amine (Compound 31)

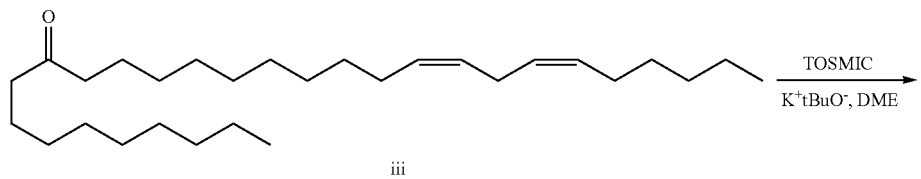

iii

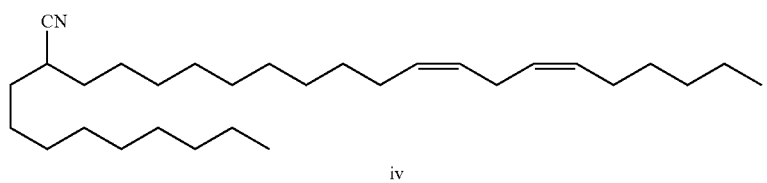

iv

A solution of keton iii (4.0 g, 9.55 mmol), TOSMIC (2.4 g, 12.4 mmol) in dimethoxyethane (45 mL) was cooled to 0° C. and treated with potassium tert-butoxide (19.1 mmol, 19.1 mL of a 1M solution in tBuOH). After 90 minutes, the reaction was partitioned between hexanes and water. The organics were washed with water, dried over sodium sulfate, filtered and evaporated in vacuo. This material was purified by flash chromatography (0-5% EtOAc/hexanes) to give desired product (containing ~20% of s.m.). This mixture was carried into next step as is. LC/MS (M+H)=430.6.

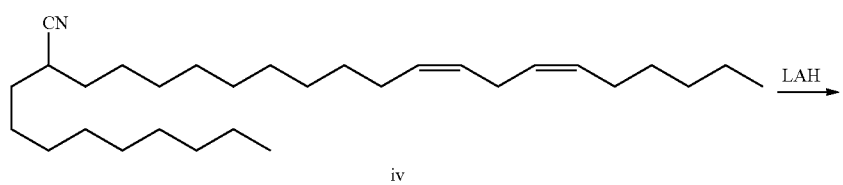

iv

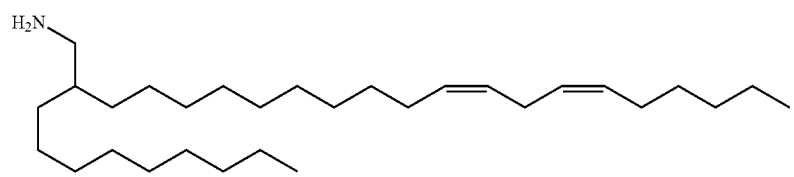

Lithium aluminum hydride (23.9 mmol, 23.9 mL of a 1M solution in THF) was added directly to nitrile iv (3.42 g, 8 mmol) at ambient temperature and the reaction was stirred for 20 minutes. The reaction was diluted with 100 mL THF, cooled to 0° C. and carefully quenched with sodium sulfate decahydrate solution. The solids were filtered off and washed with THF. The filtrate was evaporated in vacuo and carried directly into next reaction crude. LC/MS (M+H)=434.6.

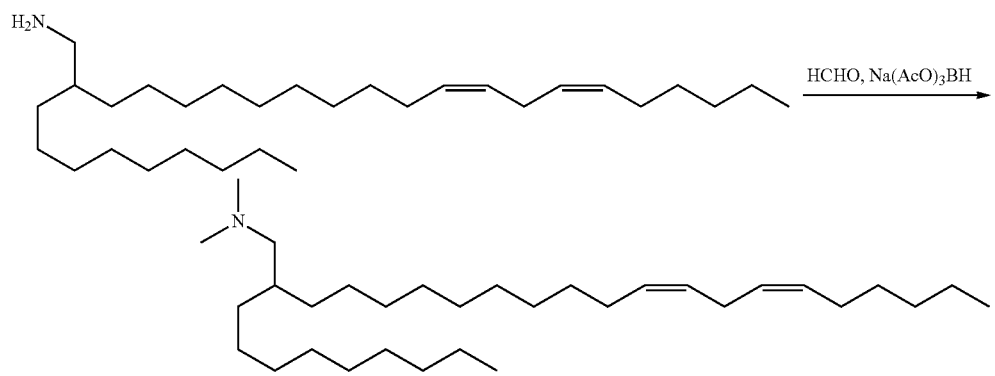

A solution of primary amine (3.45 g, 6.2 mmol) in dichloroethane (100 mL) was treated with formaldehyde (1.6 mL, 21.7 mmol) followed by sodium triacetoxyborohydride (6.6 g, 31 mmol). After 5 minutes, the reaction was partitioned between dichloromethane and 1N NaOH. The organics were dried over sodium sulfate, filtered and evaporated in vacuo. The crude mixture was purified by reverse phase preparative chromatography (C8 column) to provide (12Z,15Z)—N,N-dimethyl-2-nonylhenicosa-12,15-dien-1-amine. HRMS calc'd 462.5033. found 462.5026. $^1$H NMR (400 MHZ, CDCl$_3$) δ 5.35 (m, 4H), 2.78 (2H, t, J=5.6 Hz), 2.18 (s, 6H), 2.05 (m, 6H), 1.3 (m, 39H), 0.89 (m, 6H).

(13Z,16Z)—N,N-Dimethyl-3-Nonyldocosa-13,16-Dien-1-Amine (Compound 32)

solution was added nBuLi (16.7 mmol, 6.7 mL of a 2.5M solution). The reaction was warmed to ambient temperature for 30 minutes. The ketone (5.0 g, 11.9 mmol) was dissolved in THF (25 mL) in a second flask. The Peterson reagent was transferred to the ketone solution at −60° C. The reaction was warmed to −40° C. for 1 hour, then warmed to 0° C. for 30 minutes. The reaction was quenched with sodium bicarbonate, diluted with additional water and partitioned between water/hexanes. The organics were washed with brine, dried over sodium sulfate, filtered and evaporated in vacuo. Purifcation by flash chromatography (0-40% MTBE/hexanes) gave α,β-unsatured amide vi. $^1$H NMR (400 MHZ, CDCl$_3$) δ 5.75 (s, $^1$H), 5.36 (m, 4H), 3.01 (s, 3H), 2.99 (s,

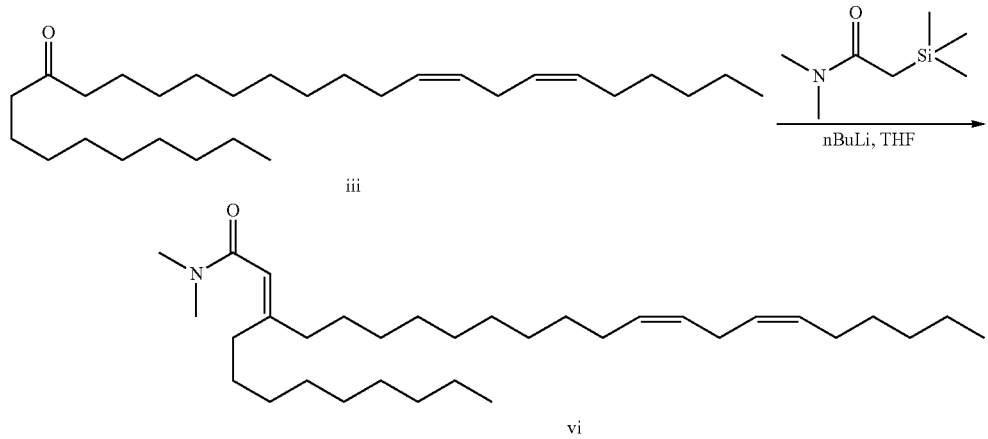

The silyl amide Peterson reagent (3.1 g, 16.7 mmol) was dissolved in THF (35 mL) and cooled to −63° C. To this 3H), 2.78 (t, 2H), 2.28 (t, 2H), 2.05 (m, 6H), 1.35 (m, 34H), 0.89 (m, 6H).

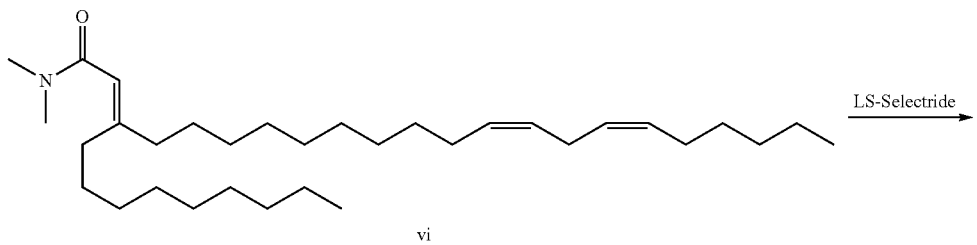

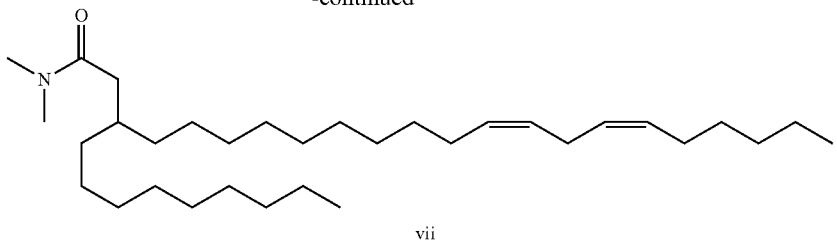

vii

α,β-unsatured amide vi (1 g, 2.1 mmol) and LS-Selectride (4.1 mmol, 4.1 mL of a 1M solution) were combined in a sealed tube and heated to 60° C. for 24 hours. The reaction was cooled to ambient temperature and partitioned between ammonium chloride solution and heptane. The organics were dried over sodium sulfate, filtered and evaporated in vacuo to give amide vii. This intermediate was carried directly into next reaction crude.

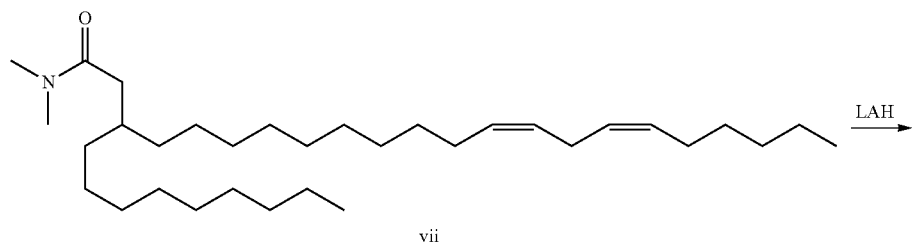

vii

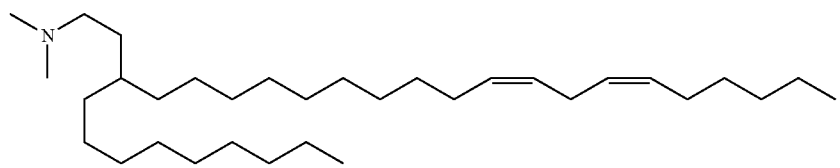 [SMILES: CCCCC/C=C\C/C=C\CCCCCCCCCC(CCCCCCCCC)CCN(C)C]

32

To a solution of amide vii (2.85 g, 5.8 mmol) was added lithium aluminum hydride (8.7 mmol, 8.7 mL of a 1M solution). The reaction was stirred at ambient temperature for 10 minutes then quenched by slow addition of sodium sulfate decahydrate solution. The solids were filtered and washed with THF and the filtrate evaporated in vacuo. The crude mixture was purified by reverse phase preparative chromatography (C8 column) to provide (13Z,16Z)—N,N-dimethyl-3-nonyldocosa-13,16-dien-1-amine (Compound 32) as an oil. HRMS (M+H) calc'd 476.5190. found 476.5189. $^1$H NMR (400 MHz, CDCl$_3$) δ 5.37 (m, 4H), 2.78 (t, 2H), 2.42 (m, 8H), 2.05 (q, 4H), 1.28 (m, 41H), 0.89 (m, 6H).

N,N-dimethyl-1-(2-octylcyclopropyl)heptadecan-8-amine (Compound 33)

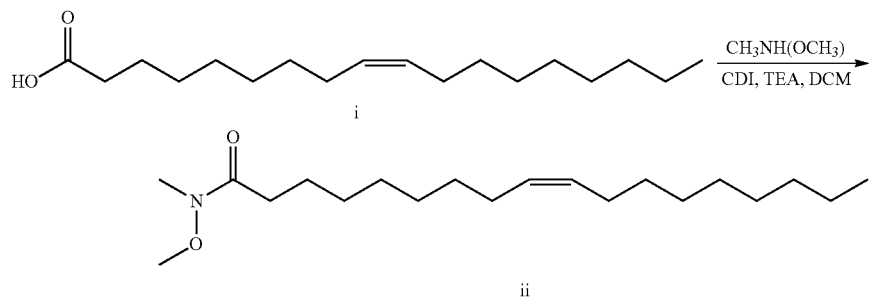

To a solution of oleic acid (1 g, 3.5 mmol) in DCM (500 mL) cooled to 0° C. was added CDI (0.63 g, 3.9 mmol). The reaction was warmed to ambient temperature for 30 minutes before cooling to 0° C. and treating first with triethylamine (0.39 g, 3.9 mmol) and then dimethyl hydroxylamine hydrochloride (0.38 g, 3.9 mmol). After 1 hour the reaction was partitioned between water and heptane. The organics were dried over magnesium sulfate, filtered and evaporate in vacuo to give crude Weinreb amide ii which was carried directly into next reaction.

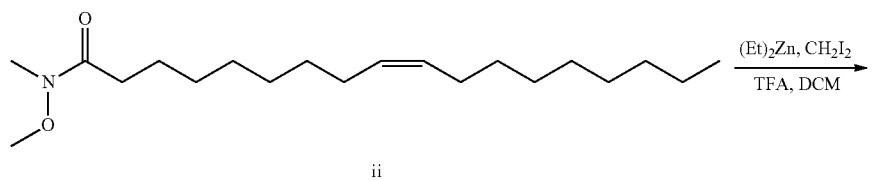

A solution of diethylzinc (70.3 mmol, 70.3 mL of a 1M solution) in dichloromethane (130 mL) was cooled to −1° C. and treated dropwise with TFA (8.0 g, 70.3 mmol). After 30 minutes, diiodomethane (18.8 g, 70.3 mmol) was added and this was aged for 30 minutes in the ice bath. To this solution was added Weinreb amide ii (7.6 g, 23.4 mmol). The reaction was warmed to ambient temperature and stirred for 1 hour. The reaction was quenched with ammonium chloride solution (100 mL) and organic layer partitioned off, washed with 10% sodium thiosulfate, dried over magnesium sulfate, filtered and evaporated in vacuo. Purification was flash chromatography (0-30% MTBE/heptane) gave desired product ix. $^1$H NMR (400 MHZ, CDCl$_3$) δ 3.72 (s, 3H), 3.22 (s, 3H), 2.48 (t, 2H), 1.65 (m, 2H), 1.39 (m, 22H), 1.18 (m, 2H), 0.91 (t, 3H), 0.68 (m, 2H), 0.59 (m, $^1$H), −0.32 (m, $^1$H).

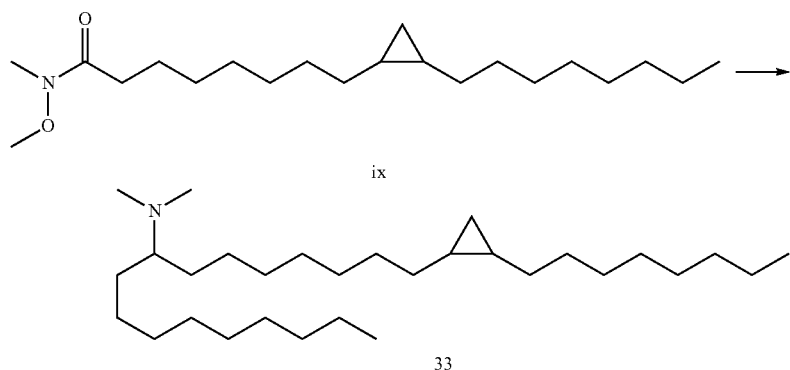

ix

33

Conversion of Weinreb amide ix to Compound 33 was carried out in a manner analogous to that described for Compound 1 above (nonyl Grignard addition followed by reductive amination). LC/MS (M+H)=436.6. $^1$H NMR (400 MHZ, CDCl$_3$) δ 2.25 (s, 6H), 1.30 (m, 45H), 0.91 (m, 6H), 0.68 (m, 2H), 0.59 (m, $^1$H), −0.31 (m, $^1$H).

Compounds 34-43 are novel cationic lipids and were prepared according to General Schemes 1~4 above.

| Compound | Structure | HRMS |
|---|---|---|
| 34 | | calcd C30H62N 436.4877, found 436.4872. |
| 35 | | calcd C32H66N 464.5190, found 464.5186. |
| 36 | | calcd C34H70N 492.5503, found 492.5496. |
| 37 | | calcd C33H66N 476.3190, found 476.5174. |
| 38 | | calcd C29H60N 422.4720, found 422.4701. |
| 39 | | calcd C30H62N 436.4877, found 436.4880. |

| Compound | Structure | HRMS |
|---|---|---|
| 40 | | calcd C32H66N 464.5190, found 464.5199. |
| 41 | | calcd C30H62N 436.4877, found 436.4877. |
| 42 | | calcd C30H62N 436.4877, found 436.4875. |
| 43 | | LC/MS (M + H) 408.6. |

(11E,20Z,23Z)—N,N-dimethylnonacosa-11,20,23-trien-10-amine (Compound 44)

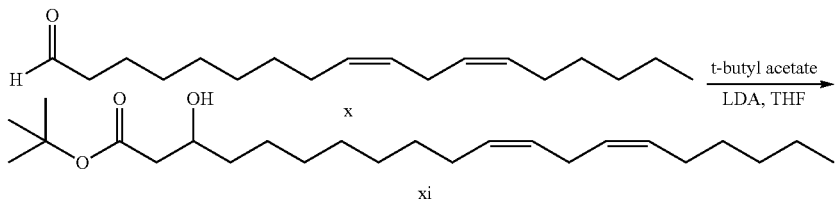

To a solution of LDA (95 mmol, 47.5 mL of a 2M solution) in THF (127 mL) cooled to −78° C. was added t-butyl acetate. The reaction was stirred for 15 minutes followed by addition of aldehyde x. The reaction was immediately quenched with ammonium chloride solution, warmed to ambient temperature and partitioned between water/pentane. The organics were dried over sodium sulfate, filtered and evaporated in vacuo. LC/MS (M+H-tBu)=325.4.

Hydroxy ketone xi (7 g, 18.4 mmol) was dissolved in dichloromethane (150 mL) and cooled to 0° C. and treated with deoxofluor (7.3 g, 33.1 mmol). The reaction was warmed to ambient temperature with stirring for 16 hours followed by quenching with sodium bicarbonate solution. The reaction was partitioned and the organics dried over sodium sulfate, filtered and evaporate in vacuo. Flash column chromotagraphy (0-5% ethyl acetate/hexanes) gave the □-fluoro ester.

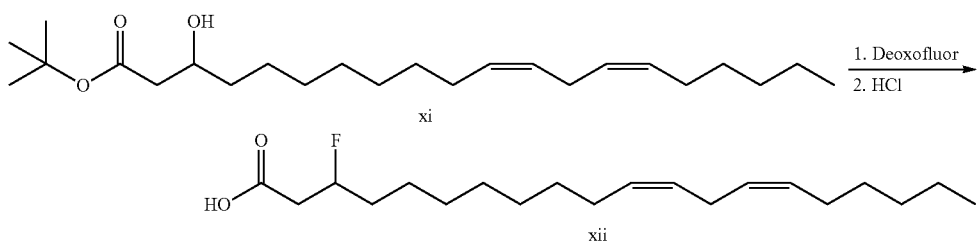

Fluoro ester intermediate (6 g, 15.6 mmol) in dichloromethane was treated with hydrogen chloride (157 mmol, 39.2 mL of a 4M solution in dioxane) and the reaction was stirred at ambient temperature for 16 hours. The reaction was evaporated in vacuo to give desired β-fluoro acid xii. LC/MS (M+H)=327.3.

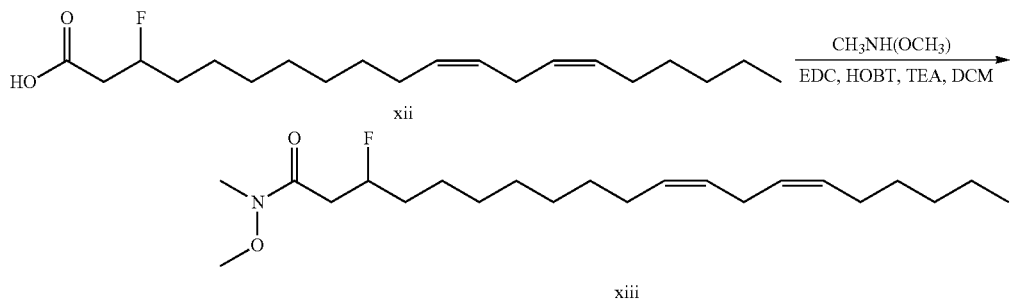

Fluoro carboxylic acid xii (5.1 g, 15.7 mmol), EDC (6.0 g, 31.4 mmol), N,O-dimethylhydroxylamine hydrochloride (3.1 g, 31.4 mmol), trimethylamine (4.0 g, 39.2 mmol), and HOAt (4.3 g, 31.4 mmol) were combined in DCM (78 mL) and stirred at ambient temperature for 16 hours. The reaction was partitioned between water/DCM and the organics were washed with water (3×) and NaOH solution (1×), dried over sodium sulfate, filtered and evaporated in vacuo. Crude material was purified by reverse phase preparative chromatography to give desired Weinreb amide xiii. LC/MS (M+H)=370.4.

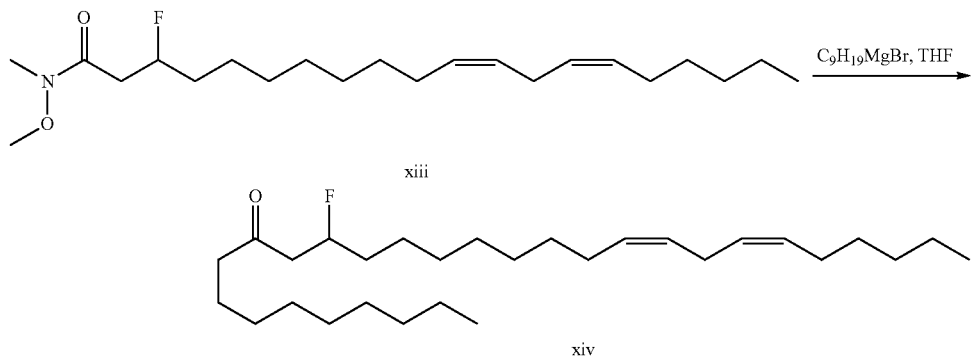

A solution of Weinreb amide xiii (4.3 g, 11.7 mmol) in THF (50 mL) was treated with nonylmagnesium bromide (23.4 mmol, 23.4 mL of a 1M solution) at ambient temperature. The reaction was quenched with ammonium chloride solution after 1 hour and partitioned between water and pentane. The organics were dried over sodium sulfate, filtered and evaporated in vacuo. This material was carried into next step crude.

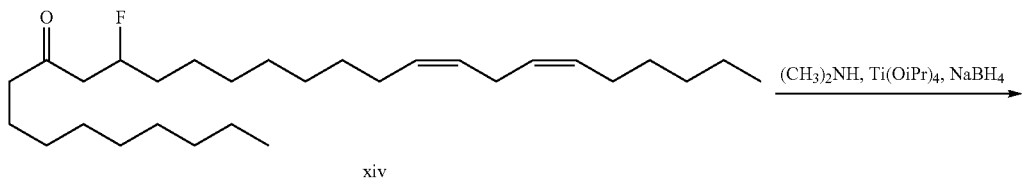

-continued

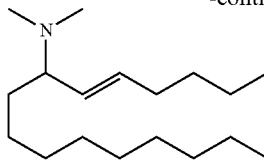

44

Ketone xiv (5.1 g, 11.7 mmol) was treated with dimethylamine (29.3 mmol, 14.7 mL of a 2M solution in THF) and titanium(IV) isopropoxide (6.7 g, 23.5 mmol) and the reaction was stirred at ambient temperature for 16 hours. To the reaction mixture was added ethanol (50 mL) followed by sodium borohydride (0.67 g, 17.6 mmol). The reaction was loaded directly onto a silica column and purified by flash chromatography (0-15% MeOH/DCM). The material required a second purification by preparative reverse phase chromatography to give (11E,20Z,23Z)—N,N-dimethyl-nonacosa-11,20,23-trien-10-amine. HRMS calc'd 446.4720. found 446.4724. $^1$H NMR (400 MHZ, CDCl$_3$) δ 5.48 (m, $^1$H), 5.37 (m, 4H), 5.23 (m, $^1$H), 2.78 (t, 2H), 2.58 (m, $^1$H), 2.22 (s, 6H), 2.04 (m, 6H), 1.56 (m, $^1$H), 1.30 (m, 31H), 0.89 (m, 6H).

Compound 45 is DLinKC2DMA as described in *Nature Biotechnology*, 2010, 28, 172-176, WO 2010/042877 A1, WO 2010/048536 A2, WO 2010/088537 A2, and WO 2009/127060 A1.

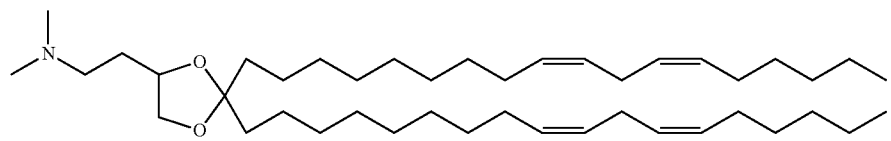

(45)

Compound 46 is MC3 as described in WO 2010/054401, and WO 2010/144740 A1.

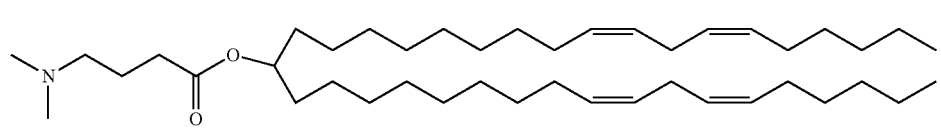

(46)

E. Lipid Nanoparticle Compositions

The following lipid nanoparticle compositions (LNPs) of the instant invention are useful for the delivery of oligonucleotides, specifically siNA molecules of the invention:

Cationic Lipid/Cholesterol/PEG-DMG 56.6/38/5.4;
Cationic Lipid/Cholesterol/PEG-DMG 60/38/2;
Cationic Lipid/Cholesterol/PEG-DMG 67.3/29/3.7;
Cationic Lipid/Cholesterol/PEG-DMG 49.3/47/3.7;
Cationic Lipid/Cholesterol/PEG-DMG 50.3/44.3/5.4;
Cationic Lipid/Cholesterol/PEG-C-DMA/DSPC 40/48/2/10;
Cationic Lipid/Cholesterol/PEG-DMG/DSPC 40/48/2/10; and
Cationic Lipid/Cholesterol/PEG-DMG/DSPC 58/30/2/10.

Example 3: Abrogation of Immunogenicity with 2'-Sugar Modifications

Unmodified RNAs, including siRNAs, induce a immunostimulatory response which is primarily mediated by endosomal Toll-like receptors (see Judge and MacLachlan, 2008, Hum Gene Ther 19, 111-24.). The subsequent immune response and release of inflammatory cytokines represents one challenge for the development of safe RNAi therapeutics. Previously published reports have investigated the immunostimulatory potentials of modified siRNAs. Judge et al evaluated 2'OMe modification of all four nucleotides in the passenger strand of an ApoB siRNA (see Judge et al., 2006, Mol Ther 13, 494-505). They report that A, G, and U modifications are effective at reducing TNF-alpha levels however 2'OMe C was surprisingly ineffective. A subset of modified siRNAs were tested in vivo in mice and confirmed the in vitro PBMC result, namely 2'OMe modifications are effective unless applied to cytidine. The cytidine result was recapitulated in a separate study which also showed that interferon-alpha induction by an unmodified RNA can be antagonized by an siRNA containing 2'OMe adenosines (see Eberle, et al., 2008, J Immunol 180, 3229-37).

Previously, 2'-Methoxy (2'OMe), fluoro (2'F), and deoxy (2'H) modified uridines were compared in single strand RNAs and all three modification types reduced TNA-alpha levels (see Sioud et al., 2007, Biochem Biophys Res Commun 361, 122-6). Interestingly only the 2'OMe modification significantly antagonized the TNFa induction by a separate unmodified RNA. Robbins et al., conducted a related experiment, evaluating the effectiveness of 2'OMe modified A, G, and C in single strand RNAs (see Robbins et al., 2007, Mol Ther 15, 1663-9). All three 2'OMe modifications effectively silenced the IFNa induction of the RNAs themselves however only 2'OMe-A completely antagonized IFNa induction by a separate unmodified RNA.

Duplex siRNAs containing combinations of 2'F and 2'OMe modifications were compared in vivo in mice (see Shin et al., 2007, Biochem Biophys Res Commun 364, 436-42). Overall methoxy modifications alone or combined with fluoro pyrimidines were effective at quieting interferon induction while fluoro-only pyrimidine modifications were less effective. Cekaite et al., employed a mRNA biomarker approach to evaluate the effects of 2'F—U and 2'OMe-U modifications on the immunostimulatory potential of single strand RNAs, finding that fluoro and methoxy uridine were equally effective at silencing the immune response (see Cekaite et al., 2007, J Mol Biol 365, 90-108). In summary the body of published literature has evaluated 2'OMe and 2'F modifications in a variety of contexts but has not yet systematically compared 2'F and 2'OMe modifications on all four nucleotides.

Here, applicant reports on the application of an in vitro human peripheral blood monocyte (PBMC) assay to measure TNF-alpha induction resulting from the administration of lipid nanoparticle (LNP) formulated siRNAs (see for example, Peacock et al., 2011, J Am Chem Soc 133, 9200-3). In a systematic screen, 2'OMe and 2'F modifications were applied in a nucleotide specific manner to either guide, passenger, or both strands of the duplex of multiple siRNAs and assayed for immune stimulation. Applicant adds to existing reports that nucleotide biases influence the ability of these ribose modifications to confer immune stealth by recapitulating known liabilities of modifying cytidine and discovers that adenosine was the only nucleotide to confer immune stealth by both 2'OMe and 2'F ribose modifications.

MATERIALS AND METHODS

Oligo sequence and synthesis: Beta-galactosidase siRNAs based on previously published siRNA sequences (see Judge et al., 2005, Nat Biotechnol 23, 457-62) with the addition of two nucleotide uridine overhangs on both strands (R-008242441-000D, see Table 1). The original published siRNAs were blunt without overhangs. The B-gal control siRNA used is a non-targeting control sequence (R-008384290-000 L). A more limited analysis was conducted with a previously published siRNA targeting ApoB (see Judge et al., 2006, Mol Ther 13, 494-505) having a phosphorylated guide strand (R-008384421-000T). Modified siRNAs were synthesized at Merck & Co. using standard methods.

siRNA formulation and administration to PBMCs: Isolation of human peripheral blood monocytes (PBMC), formulation of siRNA lipid nano particles (LNP), and administration to PBMCs was performed as previously described (see Peacock et al., 2011, J Am Chem Soc 133, 9200-3). PBMCs were purified from buffy coats (leukocytes & platelets) over a Ficoll-Paque gradient (Amersham). Cells were resuspended in freezing media (Gibco) at a concentration of 5-10 million cells per ml, aliquoted to cryogenic vials (Corning) and frozen overnight at −70° C. before transferring to appropriate liquid nitrogen cell storage system. L201 lipid mixture is a combination of 6% Peg-DMG (Sunbright), 44% Cholesterol (MP Biomedical), and 50% ClinDMA (see U.S. Pat. No. 7,514,099). Lipid mixture was sonicated until complete dissolution (~5 minutes) then cooled to room temperature. Volume was adjusted to 25 mL with ethanol then transferred to a 50 ml conical tube and stored at 4C for up to 1 week. siRNAs were diluted in HEPES Buffered Saline (20 mM Hepes, 150 mM NaCl) then mixed at 3000 RPM in a plate shaker. While shaking, an equal volume of 200 µM stock siRNA was combined with L201 lipid mixture in Costar 96-well round bottom plates. Samples were diluted with equal volume DPBS, mixed on low setting (700 RPM) for at least 5 minutes. This generates LNP formulated siRNA at 50 µM. Frozen PBMC cells were thawed, diluted to desired concentration of 250 to 500 thousand per well, and then cultured in RPMI media (Cellgro) containing 2× Pen-Strep and 10% FBS. LNP-siRNA mixture was diluted 20-fold into PBMCs freshly plated in Costar 96-well round bottom plates. Wells were quickly mixed with gentle pipetting then incubated overnight (16-20 hrs). The next day, cells were pelleted and conditioned media was aliquoted from the experiment plate to a fresh 96-well storage plate. Samples were then frozen at −80 or processed directly with cytokine ELISAs.

Cytokine ELISA assays: A white PS 96-well microplate (Nunc MaxiSorp) was coated with 100 µL/well of human TNF-alpha antibody (Thermo Scientific) diluted 1:250 in PBS. Plate was sealed and incubated overnight on the benchtop at room temperature. Plate was then blocked with 225 µL/well 4% BSA-PBS (blocking buffer) for 1 hr, RT. After overnight incubation, blocking buffer was aspirated from plates. Human TNFa standard wsa prepared from 2000 pg/mL stock as a 7-point, 2-fold serial dilution in 10% FBS-PBS into the coated plate. 80-100 µL/well of PBMC supernatant was transferred to the coated plate. Plate was incubated for 1-2 hr at room temp with gentle shaking. Plate was washed 3× with PBST then 100 µL/well of Detection Antibody diluted 1:250 in 4% BSA-PBS was added. Plate was sealed and incubated 2 hr at RT (can also incubate ON at 4C). Plate was washed 3× with PBST then 100 µL/well of strepavidin-HRP conjugate diluted 1:500 in 4% BSA-PBS was added and incubated for at least 30 min. Plates were then washed 4× with PBST. Luminol-based horseradish peroxidase detection reagent, SuperSignal West Pico Chemiluminescent Substrate (Pierce) was prepared by mixing equal parts Luminol/Enhancer in the Stable Peroxide Buffer. 100 µL ECL reagent was added to each well, mixed gently for 30 sec-1 min and then plate was read on the En Vision plate reader (Perkin Elmer).

Measurement of Beta-galactosidase activity: A mouse hepatocyte derived cell line (Hepa1-6) was co-transfected with a Beta-galactosidase plasmid (pCMV SPORT Beta-gal, Invitrogen) and siRNAs using Lipofectamine 2000 (Invitrogen). Cells were seeded at 20,000 per well in 96-well PolySorp opaque white plates (Nunc), incubated 24 hours at 37C, then transfected with 10 nM siRNA and 0.6 ng/ul of pCMV SPORT Beta-gal plasmid. Transfected cells were incubated overnight at 37C then Beta-gal enzyme activity was measured using the Gal-Screen luminescence detection system (Applied Biosystems) and SpectraMax plate reader (Molecular Devices). Luminescence values were normalized to a non-targeting control siRNA to calculate percent activity. The control siRNA sequence contains fluoro 2'F (f), methoxy 2'OMe (m), deoxy 2'H (d) and ribo 2'OH (r) residues at the indicated positions as well as inverted abasic caps (iB) on the passenger strand (R-008039829-001W).

Results

An in vitro assay was developed to measure the immunostimulatory potential of siRNAs by monitoring the induction of tumor necrosis factor alpha (TNFa) in human peripheral blood monocytes (PBMC) (see Peacock et al., 2011, J Am Chem Soc 133, 9200-3). The siRNAs were formulated in lipid nanoparticles that approximate those used for in vivo studies and the development of therapeutic siRNAs (see Abrams et al., 2010, Mol. Ther., 18: 171-80). Two published siRNAs with known immunostimulatory potentials (see Judge et al., 2005, Nat Biotechnol 23, 457-62) were selected for systematic evaluation of methoxy (2'OMe) and fluoro (2'F) ribose modifications of the four nucleotides of the passenger and guide strands. One of these siRNAs targets Beta-galactosidase (B-gal 728) while the other is a related but non-targeting control (B-gal control). Additionally applicant conducted a more limited 2'OMe analysis of an ApoB siRNA, another siRNA with previously described immune response (see Judge et al., 2006, Mol. Ther., 13: 494-505).

Evaluation of pyrimidine modifications: Methoxy modification (2'OMe) of cytidine was largely ineffective in reducing siRNA mediated immune stimulation as measured by elevation of TNFa levels in human PBMC cultures (Tables 14-17). This recapitulates published reports finding that 2'OMe modification of cytidine was not effective (see Eberle et al., 2008, J Immunol 180, 3229-37 and Shin et al., 2007, Biochem Biophys Res Commun 364, 436-42). We extend these observations to 2'-fluoro cytidine modifications (2'F) which are equally ineffective in quieting siRNA mediated TNFa induction. Uridine modification with 2'OMe is markedly more effective at reducing siRNA mediated immune stimulation (Tables 14-16); reducing TNFa levels 7-70 fold relative to unmodified control (Table 14). However, 2'F modifications resulted in significantly less reduction of TNFa levels (4-6 fold). Also of note, when the guide strand of the B-gal control siRNA was modified at only three positions, 2'F and 2'OMe conferred immune stealth is significantly compromised (Table 15). Methoxy modifications of pyrimidines in an ApoB siRNA resulted in similar trends: modified uridine reduced TNFa induction while cytidine did not (Table 17).

Evaluation of purine modifications: Modification of guanosine followed a similar pattern to that seen for uridine. Methoxy modifications are effective at reducing TNFa induction, with as few as two 2'OMe G residues on the passenger or guide strand reducing immune stimulation ~15-fold (Tables 14-18). As with uridine, 2'F modifications were not effective at significantly reducing TNFa levels on a consistent basis (Table 14) though modestly lower levels of TNFa were observed for the B-gal control siRNA (Table 15). Strikingly, either methoxy or fluoro modifications of adenosine significantly reduced TNFa levels in PBMCs (Tables 14-17). As few as three modified adenosines on the passenger strand of B-gal control siRNA could reduce TNFa levels 7-fold (2'F) or 47-fold (2'OMe) (Table 14). Methoxy modified purines were also effective at reducing TNFa induction for an ApoB siRNA (Table 17). Overall 2'OMe modified adenosines reduced TNFa levels ~50-fold while 2'F modifications reduced levels 4 to 13-fold. While 2'F mediated reduction of TNFa levels was significantly less pronounced than corresponding 2'OMe modifications, 2'F adenosine modifications were far more effective than guanosine, uridine, or cytidine.

Effect of 2' modifications on siRNA knockdown: Knockdown activity for siRNAs was measured using an in vitro cell-based assay relying on co-transfection of a plasmid containing a Beta-galactosidase transgene together with individual siRNAs. Beta-galactosidase enzymatic activity was measured with a luminescence based detection system and normalized to a non-targeting control siRNA (see Methods). The unmodified B-gal 728 siRNA reduced enzyme activity levels to 18% relative to control. The activity of methoxy and fluoro modified versions of the 728 siRNA were compared (Table 16). Generally 2'F modifications were broadly tolerated and did not negatively impact the potential of knockdown for this siRNA. However, 2'OMe modifications, in particular adenosine and guanosine, had adverse affects on knockdown.

DISCUSSION

Using two siRNAs with known immunostimulatory potentials (see Judge et al., 2005, Nat Biotechnol 23, 457-62), applicant conducted a systematic comparison of the impact of 2'OMe and 2'F modifications of guide and passenger strands on siRNA mediated immune stimulation. As reported previously, applicant found that cytidine modifications were ineffective at significantly abrogating the RNA-mediated immunestimulation as measured by TNF-alpha induction in human peripheral blood monocytes (Tables 14-17).

Uridine 2'OMe modifications were more effective at reducing TNFa levels 33 to 77 fold however modification of individual passenger or guide strands for "control" siRNA still retained significant TNFa induction, reduced only 2 to 7 fold from unmodified (Table 15). Fluoro modification of individual strands was largely ineffective while 2'F modification of both strands reduced but did not completely abrogate TNFa levels. 2'F uridine modifications have been reported to abrogate cytokine induction but this was in the context of a single stranded RNA of different sequence which may explain the differing results (see Sioud et al., 2007, Biochem Biophys Res Commun, 361, 122-6). Modification of guanosines had similar results to that observed for uridine with the notable exception that 2'F guanosines seemed even less effective at reducing TNFa levels (Tables 14-17).

In contrast with the other nucleotides, both 2'OMe and 2'F modifications of adenosine resulted in a striking reduction of TNFa levels (Tables 14-16). This effect was pronounced even for modifications of individual strands and was consistent across both siRNA sequences tested. 2'OMe adenosines reduced TNFa induction ~50-100 fold whether present on both strands or limited to either passenger or guide strands (Table 14). Uridine or guanosine 2'OMe modifications reduced TNFa levels ~15-70 fold but their immunosuppression was less consistent across strands or sequence than the effect observed for 2'OMe adenosine (Table 14). 2'F adenosine was less effective at reducing TNFa levels than 2'OMe (most evident for B-gal 728) however the suppression of RNA mediated immune response was still highly significant. Furthermore, even the limited 2'F or 2'OMe modification of just three adenosines effectively reduced immune stimulation, in marked contrast to the lack of immune stealth observed with an equivalent number of uridine modifications (Table 15).

2'F modifications are more broadly tolerated in the siRNA guide strand and have a less deleterious effect on siRNA knockdown activity than comparable 2'OMe modifications (Table 16). This suggests that 2'F modifications, and especially 2'F modified adenosines, are ideally suited for abrogation of immune stimulation while retaining activity of siRNA knockdown. Thus the immune stealth conferred by 2'F adenosines coupled with their broad tolerance in maintaining RNAi knockdown activity highlights the value of incorporating 2'F adenosine modifications into siRNA designs.

One skilled in the art would readily appreciate that the present invention is well adapted to carry out the objects and obtain the ends and advantages mentioned, as well as those inherent therein. The methods and compositions described herein, as presently representative of preferred embodiments, are exemplary and are not intended as limitations on the scope of the invention. Changes therein and other uses will occur to those skilled in the art, which are encompassed within the spirit of the invention, are defined by the scope of the claims.

I. Tables

TABLE 1

| R-Number | Target Site (human) | SEQ ID NO: | Target Sequence | Modified Sequence | SEQ ID NO: |
|---|---|---|---|---|---|
| R-007887972-001B | 9514 | 1 | CUUUAACAAUUCCUGAAAU | B cuuuAAcAAuuccuGAAAuTT B | 3 |
| R-007887972-001B | 9514 | 1 | CUUUAACAAUUCCUGAAAU | AUUucAGGAAuuGuuAAAGUU | 4 |
| R-008039792-004D | 9514 | 1 | CUUUAACAAUUCCUGAAAU | AUUucAGGAAuuGuuAAAGUU | 4 |
| R-008039792-004D | 9514 | 1 | CUUUAACAAUUCCUGAAAU | LB cuuuAAcAAuuccuGAAAuTT B | 5 |
| R-008245590-000A | 291 | 2 | ACAACAGACUUUAAUGUAA | LB AcAAcAGAcuuuAAuGuAATsT B | 6 |
| R-008245590-000A | 291 | 2 | ACAACAGACUUUAAUGUAA | UUAcAuuAAAGucuGuuGuUsU | 7 |
| R-008245595-000U | 9514 | 1 | CUUUAACAAUUCCUGAAAU | LB cuuuAAcAAuucguGAAAuTsT B | 8 |
| R-008245595-000U | 9514 | 1 | CUUUAACAAUUCCUGAAAU | AUUucAGGAAuuGuuAAAGUsU | 9 |
| R-008276371-000S | 9514 | 1 | CUUUAACAAUUCCUGAAAU | LB cuuuAAcAAuuccuGAAAuTsT B | 8 |
| R-008276371-000S | 9514 | 1 | CUUUAACAAUUCCUGAAAU | AsUsUsucAGGAAuuGuuAAAGUsU | 10 |
| R-008277560-000E | 9514 | 1 | CUUUAACAAUUCCUGAAAU | B CUUUaaCaaUUCCUgaaaUTsT B | 11 |
| R-008277560-000E | 9514 | 1 | CUUUAACAAUUCCUGAAAU | AsUsUsUCaggaaUUguUaaagUsU | 12 |
| R-008277564-000P | 9514 | 1 | CUUUAACAAUUCCUGAAAU | AsUsUsUCaggaaUUguUaaagUsU | 12 |
| R-008277564-000P | 9514 | 1 | CUUUAACAAUUCCUGAAAU | LB CUUUaaCaaUUCCUaaaaUTsT B | 13 |
| R-008298973-000K | 291 | 2 | ACAACAGACUUUAAUGUAA | LB aCaaCagaCUUUaaUgUaaTsT B | 14 |
| R-008298973-000K | 291 | 2 | ACAACAGACUUUAAUGUAA | UsUsAsCaUUaaacUCugUUsUUsU | 15 |
| R-008308489-000G | 291 | 2 | ACAACAGACUUUAAUGUAA | LB aCaaCagaCUUUaaUsUaaTsT B | 14 |
| R-008308489-000G | 291 | 2 | ACAACAGACUUUAAUGUAA | uuaCaUUaaaaUCugUUgUUsU | 16 |
| R-008308490-000W | 291 | 2 | ACAACAGACUUUAAUGUAA | LB aCaaCagaCUUUaaUgUaaTsT B | 14 |
| R-008308490-000W | 291 | 2 | ACAACAGACUUUAAUGUAA | uuACaUUaagUCugUUgUUsU | 17 |
| R-008313344-000A | 9514 | 1 | CUUUAACAAUUCCUGAAAU | LB CUUUaaCaaUUCCUgaaaUTsT B | 13 |
| R-008313344-000A | 9514 | 1 | CUUUAACAAUUCCUGAAAU | AuUUCaggaaUUguUaaagUsU | 18 |
| R-008313345-000J | 9514 | 1 | CUUUAACAAUUCCUGAAAU | LB CUUUaaCaaUUCCUgaaaUTsT B | 13 |
| R-008313345-000J | 9514 | 1 | CUUUAACAAUUCCUGAAAU | auuUCaggaaUUguUaaagUsU | 19 |
| R-008313350-000H | 9514 | 1 | CUUUAACAAUUCCUGAAAU | LB CUUUaaCaaUUCCUgaaaUTsT B | 13 |
| R-008313350-000H | 9514 | 1 | CUUUAACAAUUCCUGAAAU | AuTUCaggaaUUguUaaagUsU | 20 |
| R-008313356-000K | 9514 | 1 | CUUUAACAAUUCCUGAAAU | LB CUUUaaCaaUUCCUgaaaUTsT B | 13 |
| R-008313356-000K | 9514 | 1 | CUUUAACAAUUCCUGAAAU | auTUCaggaaUUguUaaagUsU | 21 |
| R-008333359-0001 | 291 | 2 | ACAACAGACUUUAAUGUAA | LB aCaaCagaCUUUaaUgUaaTsT B | 14 |
| R-008313359-000L | 291 | 2 | ACAACAGACUUUAAUGUAA | TuACaUUaaagUCugUUgUUsU | 22 |
| R-008313361-000J | 291 | 2 | ACAACAGACUUUAAUGUAA | LB aCaaCagaCUUUaaUgUaaTsT B | 14 |
| R-008313361-000J | 291 | 2 | ACAACAGACUUUAAUGUAA | TuACaUUaaagUCUsUUgUUsU | 23 |
| R-008277563-000X | 9514 | 1 | CUUUAACAAUUCCUGAAAU | AsUsUsCaggaaUUaAagUsU | 12 |
| R-008277562-000X | 9514 | 1 | CUUUAACAAUUCCUGAAAU | LB CUUUAACAAUUCCUGAAAUTsT B | 24 |
| R-008290704-000W | 9514 | 1 | CUUUAACAAUUCCUGAAAU | LB CUUUAACAAUUCCUGAAAUTsT B | 24 |
| R-008290704-000W | 9514 | 1 | CUUUAACAAUUCCUGAAAU | AsUsUsUCAGGAAUUGuUAAAGTsT | 25 |
| R-008347773-000D | 291 | 2 | ACAACAGACUUUAAUGUAA | LB ACAACAGACUUUAAUGUAATsT B | 26 |

TABLE 1-continued

| R-Number | Target Site (human) | SEQ ID NO: | Target Sequence | Modified Sequence | SEQ ID NO: |
|---|---|---|---|---|---|
| R-008347773-000D | 291 | 2 | ACAACAGACUUUAAUGUAA | CuACAUUAAAGUCuGUUGUTsT | 27 |
| R-008347763-000L | 291 | 2 | ACAACAGACUUUAAUGUAA | LB ACAACAGACUUUAAUGUAATsT B | 26 |
| R-008347763-000L | 291 | 2 | ACAACAGACUUUAAUGUAA | uuACAUUAAAGUCuGUUGUTsT | 28 |
| R-008357258-000C | 19 | 31 | CUCUCACAUACAAUUGAAA | B CUCUCACAUACAAUUGAAAUsU B | 111 |
| R-008357258-000C | 19 | 31 | CUCUCACAUACAAUUGAAA | UUUCAAUUGUAUGUGAGAGUsU | 112 |
| R-008357080-000R | 248 | 32 | CAGUCCUGAAGGAAUCCAU | B CAGUCCUGAAGGAAUCCAUUsU B | 113 |
| R-008357080-000R | 248 | 32 | CAGUCCUGAAGGAAUCCAU | AUGGAUUCCUUCAGGACUGUsU | 114 |
| R-008355914-000C | 397 | 33 | GGUAUGACUGUCAAAGUAA | B GGUAUGACUGUCAAAGUAAUsU B | 115 |
| R-008355914-000C | 397 | 33 | GGUAUGACUGUCAAAGUAA | UUACUUUGACAGUCAUACCUsU | 116 |
| R-008356933-000Y | 485 | 34 | CCAGUAAGGCUUCUCUUAA | B CCAGUAAGGCUUCUCUUAAUsU B | 117 |
| R-008356933-000Y | 485 | 34 | CCAGUAAGGCUUCUCUUAA | UUAAGAGAAGCCUUACUGGUsU | 118 |
| R-008356751-000W | 601 | 35 | GGCAUACAUUCGUCCCAAA | B GGCAUACAUUCGUCCCAAAUsU B | 119 |
| R-008356751-000W | 601 | 35 | GGCAUACAUUCGUCCCAAA | UUUCXXiACGAAUGUAUGCCUsU | 120 |
| R-008355911-000B | 719 | 36 | GCUUCCUCAACUAUUCUAA | B GCUUCCUCAACUAUUCUAAUsU B | 121 |
| R-008355911-000B | 719 | 36 | GCUUCCUCAACUAUUCUAA | UUAGAAUAGUUGAGGAAGCUsU | 122 |
| R-008356343-000G | 780 | 37 | CAGCAUUCUAACAGCCAAU | B CAGCAUUCUAACAGCCAAUUsU B | 323 |
| R-008356343-000G | 780 | 37 | CAGCAUUCUAACAGCCAAU | AUUGGCUGUUAGAAUGCUGUsU | 124 |
| R-008357252-000A | 1124 | 38 | GUAUAGGAAUGAAUGGAGA | B GUAUAGGAAUGAAUGGAGAUsU B | 125 |
| R-008357252-000A | 1124 | 38 | GUAUAGGAAUGAAUGGAGA | UCUCCAUUCAUUCCUAUACUsU | 126 |
| R-008356340-000F | 1445 | 39 | CCUCCUAUAAUGAAGCAAA | B CCUCCUAUAAUGAAGCAAAUsU B | 127 |
| R-008356340-000F | 1445 | 39 | CCUCCUAUAAUGAAGCAAA | UUUGCUUCAUUAUAGGAGGUsU | 128 |
| R-008357255-000B | 1446 | 40 | CUCCUAUAAUGAAGCAAAA | B CUCCUAUAAUGAAGCAAAAUsU B | 129 |
| R-008357255-000B | 1446 | 40 | CUCCUAUAAUGAAGCAAAA | UUUUGCUUCAUUAUAGGAGUsU | 130 |
| R-008356337-000Z | 1983 | 41 | CUCUCUAACUAACAAAUUU | B CUCUCUAACUAACAAAUUUUsU B | 131 |
| R-008356337-000Z | 1983 | 41 | CUCUCUAACUAACAAAUUU | AAAUUUGUUAGUUAGAGAGUsU | 132 |
| R-008355917-000D | 3214 | 42 | CAAGCAGAAGGAGUGCAGC | B CAAGCAGAAGGAGUGCAGCUsU B | 133 |
| R-008355917-000D | 3214 | 42 | CAAGCAGAAGGAGUGCAGC | GCUGCACUCCUUCUGCUUGUsU | 134 |
| R-008357077-000J | 3614 | 43 | AUGAGAUAAUAGAAUUUGA | B AUGAGAUAAUAGAAUUUGAUsU B | 135 |
| R-008357077-000J | 3614 | 43 | AUGAGAUAAUAGAAUUUGA | UCAAAUUCUAUUAUCUCAUUsU | 136 |
| R-008356128-000W | 4542 | 44 | CGUCAAAGAUAUCAAGGUU | B CGUCAAAGAUAUCAAGGUUUsU B | 137 |
| R-008356128-000W | 4542 | 44 | CGUCAAAGAUAUCAAGGUU | AACCUUGAUAUCUUUGACGUsU | 138 |
| R-008356561-000U | 6548 | 45 | GAAUUACAGAUAAUGAUGU | B GAAUUACAGAUAAUGAUGUUsU B | 139 |
| R-008356561-000U | 6548 | 45 | GAAUUACAGAUAAUGAUGU | ACAUCAUUAUCUGUAAUUCUsU | 140 |
| R-008355905-000U | 6930 | 46 | CAUUCAGCAGCUUGCUGCA | B CAUUCAGCAGCUUGCUGCAUsU B | 141 |
| R-008355905-000U | 6930 | 46 | CAUUCAGCAGCUUGCUGCA | UGCAGCAAGCUGCUGAAUGUsU | 142 |
| R-008356558-000M | 6981 | 47 | CACAAUGCAUUUAGAUCAA | B CACAAUGCAUUUAGAUCAAUsU B | 143 |
| R-008356558-000M | 6981 | 47 | CACAAUGCAUUUAGAUCAA | UUGAUCUAAAUGCAUUGUGUsU | 144 |
| R-008357083-000S | 7044 | 48 | CCGUGUCAAAUACUUUGUU | B CCGUGUCAAAUACUUUGUUUsU B | 145 |

TABLE 1-continued

| R-Number | Target Site (human) | SEQ ID NO: | Target Sequence | Modified Sequence | SEQ ID NO: |
|---|---|---|---|---|---|
| R-008357083-000S | 7044 | 148 | CCGUGUCAAAUACUUUGUU | AACAAAGUAUUUGACACGGUsU | 146 |
| R-008356334-000Y | 9414 | 49 | CAUAGAAGCCAGUAUAGGA | B CAUAGAAGCCAGUAUAGGAUsU B | 147 |
| R-008356334-000Y | 9454 | 49 | CAUAGAAGCCAGUAUAGGA | UCCUAUACUGGCUUCUAUGUsU | 148 |
| R-008357249-000U | 9514 | 1 | CUUUAACAAUUCCUGAAAU | B CUUUAACAAUUCCUGAAAUsU B | 149 |
| R-008357249-000U | 9514 | 1 | CUUUAACAAUUCCUGAAAU | AUUUCAGGAAUUGUUAAAGUsU | 150 |
| R-008356555-000L | 9621 | 1 | ACAAAGCAAUCAUUUGAUU | B ACAAAGCAAUCAUUUGAUUUsU B | 151 |
| R-008356555-000L | 9621 | 50 | ACAAAGCAAUCAUUUGAUU | AAUCAAAUGAUUGCUUUGUUsU | 152 |
| R-008356930-000X | 10162 | 51 | CAAGUGUCAUCACACUGAA | B CAAGUGUCAUCACACUGAAUsU B | 153 |
| R-00835693G-000X | 10162 | 51 | CAAGUGUCAUCACACUGAA | UUCAGUGUGAUGACACUUGUsU | 154 |
| R-008356552-000K | 10167 | 52 | GUCAUCACACUGAAUACCA | B GUCAUCACACUGAAUACCAUsUU | 155 |
| R-008356552-000K | 10167 | 52 | GUCAUCACACUGAAUACCA | UGGUAUUCAGUGUGAUGACUsU | 156 |
| R-008356331-000X | 10168 | 53 | UCAUCACACUGAAUACCAA | B UCAUCACACUGAAUACCAAUsU B | 157 |
| R-008356331-000X | 10168 | 53 | UCAUCACACUGAAUACCAA | UUGGUAUUCAGUGUGAUGAUsU | 158 |
| R-008356125-000V | 10219 | 54 | CAGUACAAAUUAGAGGGAA | B CACUACAAAUUAGAGGGAAUsU B | 159 |
| R-008356125-000V | 10219 | 54 | CAGOACAAAUUAGAGGGAA | UUCCCUCUAAUUUGUACUGUsU | 160 |
| R-008356549-000D | 10455 | 55 | GAACUUAAUGGAAAUACCA | B GAACUUAAUGGAAAUACCAUsU B | 161 |
| R-008356549-000D | 10455 | 55 | GAACUUAAUGGAAAUACCA | UGGUAUUUCCAUUAAGUUCUsU | 162 |
| R-008356329-000Z | 10517 | 56 | UUGAUCACAAGUUCAGCUU | B UUGAUCACAAGUUCAGCUUUsU B | 163 |
| R-008356329-000Z | 10517 | 56 | UUGAUCACAAGUUCAGCUU | AAGCUGAACUUGUGAUCAAUsU | 164 |
| R-008356326-000Y | 12673 | 57 | GAGAAAUCAAGAUUAAUCA | B GAGAAAUCAAGAUUAAUCAUsU B | 165 |
| R-008356326-000Y | 12673 | 57 | GAGAAAUCAAGAUUAAUCA | UGAUUAAUCUUGAUUUCUCUsU | 166 |
| R-008356748-000P | 13666 | 58 | CUUUGUAGACUACUAUAAA | B CUUUGUAGACUACUAUAAAUsU B | 167 |
| R-008356748-000P | 13666 | 58 | CUUUGUAGACUACUAUAAA | UUUAUAGUAGUCUACAAAGUsU | 168 |
| R-008355979-000A | 19 | 31 | CUCUCACAUACAAUUGAAA | B CUCUCaCaUaCaaUUcaaaTsT B | 169 |
| R-008355979-000A | 19 | 31 | CUCUCACAUACAAUUGAAA | UsUsUsCaaUUgUaUgucagagUsU | 170 |
| R-008356396-000V | 248 | 32 | CAGUCCUGAAGGAAUCCAU | B CaaUCCUaaaggaaUCCaUTsT B | 171 |
| R-008356396-000V | 248 | 32 | CAGUCCUGAAGGAAUCCAU | AsUsGsgaUUCCUUCaggaCUgUsU | 172 |
| R-008357291-000L | 397 | 33 | GGUAUGACUGUCAAAGUAA | B ggUaUgaCUaUCaaagUaaTsT B | 173 |
| R-008357291-000L | 397 | 33 | GGUAUGACUGUCAAAGUAA | UsUsUsCUUUgaCagUcaUaCCUsU | 174 |
| R-008357122-000N | 485 | 34 | CCAGUAAGGCUUCUCUUAA | B CCacUaaggCUUCUCUUaaTsT B | 175 |
| R-008357122-000N | 485 | 34 | CCAGUAAGGCUUCUCUUAA | UsUsAsagagaagCCUuaCUggUsU | 176 |
| R-008355976-000Z | 601 | 35 | GGCAUACAUUCGUCCCAAA | B ggCaUaCaUUCgUCCCaaaTsT B | 177 |
| R-008355976-000Z | 601 | 35 | GGCAUACAUUCGUCCCAAA | UsUsUsgggaCgaaUguaUgCCUsU | 178 |
| R-008357288-000E | 719 | 36 | GCUUCCUCAACUAUUCUAA | B aCUUCCUCaaCUaUUCUaaTsT B | 179 |
| R-008357288-000E | 719 | 36 | GCUUCCUCAACUAUUCUAA | UsUsAsgaaUagUUgaggaagCUsU | 180 |
| R-008356569-000N | 780 | 37 | CAGCAUUCUAACAGCCAAU | B CagCaUUCUaaCagCCaaUTsT B | 181 |
| R-008356569-000N | 780 | 37 | CAGCAUUCUAACAGCCAAU | AsUsUsgggCUgUUagaaUgCUgUsU | 182 |
| R-008356393-000U | 1124 | 38 | GUAUAGCAAUGAAUGGAGA | B gUaUaggaaUgaaUggagaTsT B | 183 |

TABLE 1-continued

| R-Number | Target Site (human) | SEQ ID NO: | Target Sequence | Modified Sequence | SEQ ID NO: |
|---|---|---|---|---|---|
| R-008356393-000U | 1124 | 38 | GUAUAGGAAUGAAUGGAGA | UsCsUsCCaUUCaUUCcUaUaCUsU | 184 |
| R-008355973-000Y | 1445 | 39 | CCUCCUAUAAUGAAGCAAA | B CCUCCUaUaaUgaagCaaaTsT B | 185 |
| R-008355973-000Y | 1445 | 39 | CCUCCUAUAAUGAAGCAAA | UsUsUsgCUUCaUUaUaggaggUsU | 186 |
| R-008356941-000Y | 1446 | 40 | CUCCUAUAAUGAAGCAAAA | B CUCCUaUaaUgaagCaaaaTsT B | 187 |
| R-008356941-000Y | 1446 | 40 | CUCCUAUAAUGAAGCAAAA | UsUsUsUgCUUCaUUauaggsagUsU | 188 |
| R-008356184-000R | 1983 | 41 | CUCUCUAACUAACAAAUUU | B CUCUCUaaCUaaCaaaUUUTsT B | 189 |
| R-008356184-000R | 1983 | 41 | CUCUCUAACUAACAAAUUU | AsAsAsUUUgUUagUUagagagUsU | 190 |
| R-008356351-000G | 3714 | 42 | CAAGCAGAAGGAGUGCAGC | B CaagCagaaggagUgCagCTsT B | 191 |
| R-008356351-000G | 3314 | 42 | CAAGCAGAAGCAGUGCACC | GsCsUsgCaCUCCUUCucCUUgUsU | 192 |
| R-008356795-000A | 3614 | 43 | AUGAGAUAAUAGAAUUUGA | B aUgagaUaaUagaaUUUgaTsT B | 193 |
| R-008356795-000A | 3614 | 43 | AUGAGAUAAUAGAAUUUGA | UsCsAsaaUUCUaUUauCUCaUUsU | 194 |
| R-008356604-000A | 4542 | 44 | CGUCAAAGAUAUCAAGGUU | B CgUCaaagaUaUCaaggUUTsT B | 195 |
| R-008356604-000A | 4542 | 44 | CGUCAAAGAUAUCAAGGUU | AsAsCsUUgaUaUCUaUgaCgUsU | 196 |
| R-008356134-000D | 6548 | 45 | GAAUUACAGAUAAUGAUGU | B gaaUUaCagaUaaUgaUgUTsT B | 197 |
| R-008356134-000D | 6548 | 45 | GAAUUACAGAUAAUGAUGU | AsCsAsUCaUUaUCUguaUUCUsU | 198 |
| R-008357119-000G | 6930 | 46 | CAUUCAGCAGCUUGCUGCA | B CaUUCagCagCUUgCUgCaTsT B | 199 |
| R-008357119-000G | 6930 | 46 | CAUUCAGCAGCUUGCUGCA | UsGsCsagCaagCUcCugaaUgUsU | 200 |
| R-008356181-000P | 6981 | 47 | CACAAUGCAUUUAGAUCAA | B CaCaaUaCaUUUacaUCaaTsT B | 201 |
| R-008356181-000P | 6981 | 47 | CACAAUGCAUUUAGAUCAA | UsUsGsaUCUaaaUgCaUUgUgUsU | 202 |
| R-008355923-000L | 7044 | 48 | CCGUGUCAAAUACUUUGUU | B CCgUgUCaaaUaCUUUgUUTsT B | 203 |
| R-008355923-000L | 7044 | 48 | CCGUGUCAAAUACUUUGUU | AsAsCsaaagUaUUUgaCaCscUsU | 204 |
| R-008356969-000C | 9414 | 49 | CAUAGAAGCCAGUAUAGGA | B CaUaaaagCCaaUaUaggaTsT B | 205 |
| R-008356969-000C | 9414 | 49 | CAUAGAAGCCAGUAUAGGA | UsCsCsUaUaCUggCUuCUaUaUsU | 206 |
| R-008356767-000R | 9621 | 50 | ACAAAGCAAUCAUUUGAUU | B aCaaagCaaUCaUUUsaUUTsT B | 207 |
| R-008356767-000R | 9621 | 50 | ACAAAGCAAUCAUUUGAUU | AsAsUsCaaaUcaUUsgUUUcUUsU | 208 |
| R-008356601-000Z | 10162 | 51 | CAAGUGUCAUCACACUGAA | B CaaaUsCaUCaCaCUgaaTsT B | 209 |
| R-008356601-000Z | 10162 | 51 | CAAGUGUCAUCACACUGAA | UsUsCsagUgUgaUgacaCUUgUsU | 210 |
| R-008356598-000G | 10167 | 52 | GUCAUCACACUGAAUACCA | B gUCaUCaCaCUgaaUaCCaTsT B | 211 |
| R-008356598-000G | 10167 | 52 | GUCAUCACACUGAAUACCA | UsGsGsUaUUCagUgUgaUgaCUsU | 212 |
| R-008279809-000X | 10168 | 53 | UCAUCACACUGAAUACCAA | B UCaUCaCaCUgaaUaCCaaTsT B | 213 |
| R-008279809-000X | 10168 | 53 | UCAUCACACUGAAUACCAA | UsUsGsgUaUUCaaUgugaUgaUsU | 214 |
| R-008355970-000X | 10219 | 54 | CAGUACAAAUUAGAGGGAA | B CagUaCaaaUUagagggaaTsT B | 215 |
| R-008355970-000X | 10219 | 54 | CAGUACAAAUUAGAGGGAA | UsUsCsCCUCUaaUUUgUaCUaUsU | 216 |
| R-008355967-000R | 10455 | 55 | GAACUUAAUGGAAAUACCA | B gaaCUUaaUggaaaUaCCaTsT B | 217 |
| R-008355967-000R | 10455 | 55 | GAACUUAAUGGAAAUACCA | UsGsGsUaUUUCCaUUaagUUCUsU | 218 |
| R-008356178-000H | 10517 | 56 | UUGAUCACAAGUUCAGCUU | B UUgaUCaCaagUUcagCUUTsT B | 219 |
| R-008356178-000H | 10517 | 56 | UUGAUCACAAGUUCAGCUU | AsAsGsCUaaaCUUaUsaUCaaUsU | 220 |
| R-008356792-000Z | 12673 | 57 | GAGAAAUCAAGAUUAAUCA | B gagaaaUCaagaUUaaUCaTsT B | 221 |

TABLE 1-continued

| R-Number | Target Site (human) | SEQ ID NO: | Target Sequence | Modified Sequence | SEQ ID NO: |
|---|---|---|---|---|---|
| R-008356792-000Z | 12673 | 57 | GAGAAAUCAAGAUUAAUCA | UsGsAsUUaaUCUUaauUUCUCUsU | 222 |
| R-008356387-000L | 13666 | 58 | CUUUGUAGACUACUAUAAA | B CUUUsUagaCUaCUaUaaaTsT B | 223 |
| R-008356387-000L | 13666 | 58 | CUUUGUAGACUACUAUAAA | UsUsUsaUagUagUCUaCaaasUsU | 224 |
| R-008391240-000E | 70 | 59 | CGUUGAUAACCCAAAUGGA | B CGUUGAUAACCCAAAUGGAUsU B | 225 |
| R-008391240-000E | 70 | 59 | CGUUGAUAACCCAAAUGGA | UCCAUUUGGGUUAUCAACGUsU | 226 |
| R-008391213-000D | 93 | 60 | IGAAGAUGCGUGACAUGUAU | B GAAGAUGCGUGACAUGUAUUsU B | 227 |
| R-008391213-000D | 93 | 60 | GAAGAUGCGUGACAUGUAU | AUACAUGUCACGCAUCUUCUsU | 228 |
| R-008313809-000Y | 146 | 61 | AGUGGAGGUAUUCUUCGAA | B AGUGGAGGUAUUCUUCGAAUsU B | 229 |
| R-008313809-000Y | 146 | 61 | AGUGGAGGUAUUCUUCGAA | UUCGAAGAAUACCUCCACUUsU | 230 |
| R-008313864-000J | 196 | 62 | CAUUGAACCCAAAUUUGAU | B CAUUGAACCCAAAUUUGAUUsU B | 231 |
| R-008313864-000J | 196 | 62 | CAUUGAACCCAAAUUUGAU | AUCAAAUUUGGGUUCAAUGUsU | 232 |
| R-008391328-000Z | 284 | 63 | OCAUAACUGUUUGGUAUU | B GCAUAACUGUUUGGUAUUUsU B | 233 |
| R-008391328-000Z | 284 | 63 | GCAUAACUGUUUGGUAUU | AAUACCAAACAGUUAUUGCUsU | 234 |
| R-008391263-000R | 384 | 64 | CAGUCAGCAAAGACGUCUA | B CAGUCAGCAAAGACGUCUAUsU B | 235 |
| R-008391263-000R | 384 | 64 | CAGUCAGCAAAGACGUCUA | UAGACGUCUUUGCUGACUGUsU | 236 |
| R-008391207-000W | 420 | 65 | GCAGUACCCACGUCACCUA | B GCAGUACCCACGUCACCUAUsU B | 237 |
| R-008391207-000W | 420 | 65 | GCAGUACCCACGUCACCUA | UAGGUGACGUGGGUACUGCUsU | 238 |
| R-008391296-000U | 485 | 66 | GAGACACCUGCCUGGUAUU | B GAGACACCUGCCUGGUAUUUsU B | 239 |
| R-008391296-000U | 485 | 66 | GAGACACCUGCCUGGUAUU | AAUACCAGGCAGGUGUCUCUsU | 240 |
| R-008391228-000P | 661 | 67 | GAAACAAGGGCCCUUUGUA | B GAAACAAGGGCCGUUUGUAUsU B | 241 |
| R-008391228-000P | 661 | 67 | GAAACAAGGGCCCUUUGUA | UACAAAGGGCCCUUGUUUCUsU | 242 |
| R-008391414-000G | 780 | 68 | CAAGGACCCCGGCUGCGAA | B CAAGGACCCCGGCUGCGAAUsU B | 243 |
| R-008391414-000G | 780 | 68 | CAAGGAGCCCGGCUGGGAA | UUCGCAGCCGGGUCCUUGUsU | 244 |
| R-008391414-000F | 849 | 69 | CGGGAAGCUGGGCAGCUAC | B CGGGAAGCUCUGGGCAGCUACUsU B | 245 |
| R-008391411-000F | 849 | 69 | CGGGAAGCUGGGCAGCUAC | GUAGCUGCCCAGCUUCCCGUsU | 246 |
| R-008391314-000X | 881 | 70 | GGACGAAAGCCAUGGUUGC | B GCTACGAAAGCCAUGGUUGCUsU B | 247 |
| R-008391314-000X | 881 | 70 | GGACGAAAGCCAUGGUUGC | GCAACCAUGGCUUUCGUCCUsU | 248 |
| R-008391325-000Y | 887 | 71 | AAGCCAUGGUUGCUUGUUA | B AAGCCAUGGUUGCUUGUUAUsU B | 249 |
| R-008391325-000Y | 887 | 71 | AAGCCAUGGUUGCUUGUUA | UAACAAGCAACCAUGGCUUUsU | 250 |
| R-008350794-C00Z | 955 | 72 | GAUGGAAGAUGUGUGACAU | B GAUGGAAGAUGUGUGACAUUsU B | 251 |
| R-0G8350794-000Z | 955 | 72 | GAUGGAAGAUGUGUGACAU | AUGUCACACAUCUUCCAUCUsU | 252 |
| R-008350713-000B | 962 | 73 | GAUGUGUGACAUGUAUAUA | B GAUGUGUGACAUGUAUAUAUsU B | 253 |
| R-008350713-000B | 962 | 73 | GAUGUGUGACAUGUAUAUA | UAUAUACAUGUCACACAUCUsU | 254 |
| R-008391266-000S | 994 | 74 | GACUGGGAUGCCAAGGUAA | B GACUGGGAUGCCAAGGUAAUsU B | 255 |
| R-008391266-000S | 994 | 74 | GACUGGGAUGCCAAGGUAA | UUACCUUGGCAUCCCAGUCUsU | 256 |
| R-008391357-000T | 1048 | 75 | GCCCAGUUUGCUGACAUUG | B GCCCAGUUUGCUGACAUUGUsU B | 257 |
| R-008391357-000T | 1048 | 75 | GCCCAGUUUGCUGACAUUG | CAAUGUCAGCAAACUGGGCUsU | 258 |
| R-008391234-000X | 1055 | 76 | UUGCUGACAUUGAACCCAA | B UUGCUGACAUUGAACCCAAUsU B | 259 |

TABLE 1-continued

| R-Number | Target Site (human) | SEQ ID NO: | Target Sequence | Modified Sequence | SEQ ID NO: |
|---|---|---|---|---|---|
| R-008391234-000X | 1055 | 76 | UUGCUGACAUUGAACCCAA | UUGGGUUCAAUGUCAGCAAUsU | 260 |
| R-008391302-000M | 1107 | 77 | UCGCAACCCUCAUGAAGUA | B UCGCAACCCUCAUGAAGUAUsU B | 261 |
| R-008391302-000M | 1107 | 77 | UCGCAACCCUCAUGAAGUA | UACUUCAUGAGGGUUGCGAUsU | 262 |
| R-008391299-000V | 1115 | 78 | CUCAUGAAGUACAACCACC | B CUCAUGAAGUACAACCAGCUsU B | 263 |
| R-008391299-000V | 1115 | 78 | CUCAUGAAGUACAACCAGC | GCUGGUUGUACUUCAUGAGUsU | 264 |
| R-008391354-000S | 1223 | 79 | GUGUGAGGGUUGAACUCAA | B GUGUGAGGGUUGAACUCAAUsU B | 265 |
| R-008391354-000S | 1223 | 79 | GUGUGAGGGUUGAACUCAA | UUGAGUUCAACCCUCACACUsU | 266 |
| R-008313818-000G | 4295 | 80 | AUGCUACAAGGUACGCAAU | B AUGCUACAAGGUACGCAAUUsU B | 267 |
| R-008313818-000G | 4295 | 80 | AUGCUACAAGGUACGCAAU | AUUGCGUACCUUGUAGCAUUsU | 268 |
| R-008313815-000F | 4302 | 81 | AAGGUACGCAAUAACUGUU | B AAGGUACGCAAUAACUGUUUsU B | 269 |
| R-008313815-000F | 4302 | 81 | AAGGUACGCAAUAACUGUU | AACAGUUAUUGCGUACCUUUsU | 270 |
| R-008391381-000T | 4381 | 82 | GGUGUGAGGGUUGAACUCA | B GGUGUGAGGGUUGAACUCAUsU B | 271 |
| R-008391381-000T | 4381 | 82 | GGUGUGAGGGUUGAACUCA | UGAGUUCAACCCUCACACCUsU | 272 |
| R-008391351-000R | 70 | 59 | CGUUGAUAACCCAAAUGGA | B CgUUgaUaaCCCaaaUggaTsT B | 273 |
| R-008391351-000R | 70 | 59 | CGUUGAUAACCCAAAUGGA | UsCsCsaUUUscaUUauCaaCgUsU | 274 |
| R-008391293-000T | 93 | 60 | GAAGAUGCGUGACAUGUAU | B gaagaUgCgUgaCaUgUaUTsT B | 275 |
| R-008391293-000T | 93 | 60 | GAAGAUGCGUGACAUGUAU | AsUsAsCaUgUCaCgCaUCUUCUsU | 276 |
| R-008391258-000S | 146 | 61 | AGUGGAGGUAUUCUUCGAA | B agUggaggUaUUCUUCgaaTsT B | 277 |
| R-008391258-000S | 146 | 61 | AGUGGAGGUAUUCUUCGAA | UsUsCsgaagaaUaCCuCCaCUUsU | 278 |
| R-008391290-000S | 196 | 62 | CAUUGAACCCAAAUUUGAU | B CaUUgaaCCCaaaUUUsaUTsT B | 279 |
| R-008391290-000S | 196 | 62 | CAUUGAACCCAAAUUUGAU | AsUsCsaaaUUUacaUuCaaUgUsU | 280 |
| R-008391372-000J | 284 | 63 | GCAAUAACUGUUUGGUAUU | B gCaaUaaCUgUUUagUaUUTsT B | 281 |
| R-008391372-000J | 284 | 63 | GCAAUAACUGUUUGGUAUU | AsAsUsaCCaaaCagUuaUUgCUsU | 282 |
| R-008391348-000J | 384 | 64 | CAGUCAGCAAAGACGUCUA | B CagUCagCaaagaCgUCUaTsT B | 283 |
| R-008391348-000J | 384 | 64 | CAGUCAGCAAAGACGUCUA | UsAsGsaCgUCUUUaCugaCUgUsU | 284 |
| R-008391287-000K | 420 | 65 | GCAGUACCCACGUCACCUA | B gCagUaCCCaCcUCaCCUaTsT B | 285 |
| R-008391287-000K | 420 | 65 | GCAGUACCCACGUCACCUA | UsAsGsgUgaCgUgggUaCUgCUsU | 286 |
| R-008391345-000H | 485 | 66 | GAGACACCUGCCUGGUAUU | B aagaCaCCUgCCUagUaUUTsT B | 2S7 |
| R-008391345-000H | 485 | 66 | GAGACACCUGCCUGGUAUU | AsAsUsaCCaaaCaaguaUCUCUsU | 288 |
| R-008391311-000W | 661 | 67 | GAAACAAGGGCCCUUUGUA | B gaaaCaagggCCCUUUgUaTsT B | 289 |
| R-008391311-000W | 661 | 67 | GAAACAAGGGCCCUUUGUA | UsAsCsaaagggCCCUugUUUCUsU | 290 |
| R-008391369-000C | 780 | 68 | CAAGGAGCCCGGCUGCGAA | B CaaagaaCCCggCUgCgaaTsT B | 291 |
| R-008391369-000C | 780 | 68 | CAAGGAGCCCGGCUGCGAA | UsUsCsaCaaCCaagCuCCUUgUsU | 292 |
| R-008391342-000G | 849 | 69 | CGGGAAGCUGGGCAGCUAC | B CgggaaaCUgsgCagCUaCTsT B | 293 |
| R-008391342-000G | 849 | 69 | CGGGAAGCUGGGCAGCUAC | GsUsAsgCUgCCCagCuUCCCgUsU | 294 |
| R-008391366-000B | 881 | 70 | GGACGAAAGCCAUGGUUGC | B ggaCgaaagCCaUggUUgCTsT B | 295 |
| R-008391366-000B | 881 | 70 | GGACGAAAGCCAUGGUUGC | GsCsAsaCCaUggCUUuCgUCCUsU | 296 |
| R-008391405-000Y | 887 | 71 | AAGCCAUGGUUGCUUGUUA | B aacCCaUggUUgCUUgUUaTsT B | 297 |

TABLE 1-continued

| R-Number | Target Site (human) | SEQ ID NO: | Target Sequence | Modified Sequence | SEQ ID NO: |
|---|---|---|---|---|---|
| R-008391405-000Y | 887 | 71 | AAGCCAUGGUUGCUUGUUA | UsAsAsCaagCaaCCauggCUUUsU | 298 |
| R-008391255-000R | 955 | 72 | GAUGGAAGAUGUGUGACAU | B gaUggaagaUgUgUgaCaUTsT B | 299 |
| R-008391255-000R | 955 | 72 | GAUGGAAGAUGUGUGACAU | AsUsGsUCaCaCaUCUuCCaUCUsU | 300 |
| R-008391402-000X | 962 | 73 | GAUGUGUGACAUGUAUAUA | B gaUgUgUgaCaUgUaUaUaTsT B | 301 |
| R-008391402-000X | 962 | 73 | GAUGUGUGACAUGUAUAUA | UsAsUsaUaCaUgUCacaCaUCUsU | 302 |
| R-008391192-000Z | 994 | 74 | GACUGGGAUGCCAAGGUAA | B gaCUgggaUgCCaaggUaaTsT B | 303 |
| R-008391192-000Z | 994 | 74 | GACUGGGAUGCCAAGGUAA | UsUsAsCCUUgaCaUCcCacUCUsU | 304 |
| R-008391284-000J | 1048 | 75 | GCCCAGUUUGCUGACAUUG | B gCCCagUUUgCUgaCaUUgTsT B | 305 |
| R-008391284-000J | 1048 | 75 | GCCCAGUUUGCUGACAUUG | CsAsAsUgUCagCaaacUgggCUsU | 306 |
| R-008391281-000H | 1055 | 76 | UUGCUGACAUUGAACCCAA | B UUgCUgaCaUUgaaCCCaaTsT B | 307 |
| R-008391281-000H | 1055 | 76 | UUGCUGACAUUGAACCCAA | UsUsGsggUUCaaUgUcagCaaUsU | 308 |
| R-008391201-000U | 1107 | 77 | UCGCAACCCUCAUGAAGUA | B UCgCaaCCCUCaUgaagUaTsT B | 309 |
| R-008391201-000U | 1107 | 77 | UCGCAACCCUCAUGAAGUA | UsAsCsUUCaUgacGauUgCgaUsU | 310 |
| R-008391252-000P | 1115 | 78 | CUCAUGAAGUACAACCAGC | B CUCaUgaaUUaCaaCCagCTsT B | 311 |
| R-008391252-000P | 1115 | 78 | CUCAUGAAGUACAACCAGC | GsCsUsggUUgUaCUUcaUgagUsU | 312 |
| R-008391198-000B | 1223 | 79 | GUGUGAGGGUUGAACUCAA | B gUgUgagggUUgaaCUCaaTsT B | 313 |
| R-008391198-000B | 1223 | 79 | GUGUGAGGGUUGAACUCAA | UsUsGsagUUCaaCCCuCaCaCUsU | 314 |
| R-008391249-000H | 4295 | 80 | AUGCUACAAGGUACGCAAU | B aUgCUaCaaggUaCsCaaUTsT B | 315 |
| R-008391249-000H | 4295 | 80 | AUGCUACAAGGUACGCAAU | AsUsUsgCgUaCCUUguagCaUUsU | 316 |
| R-008391246-000G | 4302 | 81 | AAGGUACGCAAUAACUGUU | B aaggUaCgCaaUaaCUgUUTsT B | 317 |
| R-008391246-000G | 4302 | 81 | AAGGUACGCAAUAACUGUU | AsAsCsagUUaUUgCguaCCUUUsU | 318 |
| R-008391222-000M | 4381 | 82 | GGUGUGAGGGUUGAACUCA | B ggUgUgagggUUgaaCUCaTsT B | 319 |
| R-008391222-000M | 4381 | 82 | GGUGUGAGGGUUGAACUCA | UsGsAsaUUCaaCCCUcaCaCCUsU | 320 |
| R-008357193-000U | 243 | 83 | UGAAGGCUGGGUACCUUUG | B UGAAGGCUGGGUACCUUUGsU B | 321 |
| R-008357193-000U | 243 | 83 | UGAAGGCUGGGUACCUUUG | CAAAGGUACCCAGCCUUCAUsU | 322 |
| R-008356271-000G | 253 | 84 | AUCUGUCAUCAAAUUGAGU | B AUCUGUCAUCAAAUUGAGUUsU B | 323 |
| R-008356271-000G | 253 | 84 | AUCUGUCAUCAAAUUGAGU | ACUCAAUUUGAUGACAGAUUsU | 324 |
| R-008356480-000K | 254 | 85 | UCUGUCAUCAAAUUGAGUA | B UCUGUCAUCAAAUUGAGUAUsU B | 325 |
| R-008356480-000K | 254 | 85 | UCUGUCAUCAAAUUGAGUA | UACUCAAUUUGAUGACAGAUsUUsU | 326 |
| R-008356688-000Z | 255 | 86 | CUGUCAUCAAAUUGAGUAU | B CUGUCAUCAAAUUGAGUAUUsU B | 327 |
| R-008356688-000Z | 255 | 86 | CUGUCAUCAAAUUGAGUAU | AUACUCAAUUUGAUGACAGUUsU | 328 |
| R-008357396-000P | 257 | 87 | GUCAUCAAAUUGAGUAUUA | B GUCAUCAAAUUGAGUAUUAUsU B | 329 |
| R-008357396-000P | 257 | 87 | GUCAUCAAAUUGAGUAUUA | UAAUACUCAAUUUGAUGACUsU | 330 |
| R-008356265-000Z | 258 | 88 | UCAUCAAAUUGAGUAUUAU | B UCAUCAAAUUGAGUAUUAUUsU B | 331 |
| R-008356265-000Z | 258 | 88 | UCAUCAAAUUGAGUAUUAU | AUAAUACUCAAUUUGAUGAUsU | 332 |
| R-008357199-000W | 279 | 89 | UGGAGACUUCAAUUUGCCA | B UGGAGACUUCAAUUUGCCAUsU B | 333 |
| R-008357199-000W | 279 | 89 | UGGAGACUUCAAUUUGCCA | UGGCAAAUUGAAGUCUCCAUsU | 334 |
| R-008356273-000Z | 291 | 2 | ACAACAGACUUUAAUGUAA | B ACAACAGACUUUAAUGUAAUsU B | 335 |

TABLE 1-continued

| R-Number | Target Site (human) | SEQ ID NO: | Target Sequence | Modified Sequence | SEQ ID NO: |
|---|---|---|---|---|---|
| R-0C8356273-000Z | 291 | 2 | ACAACAGACUUUAAUGUAA | UUACAUUAAAGUCUGUUGUUsU | 336 |
| R-008356262-000Y | 329 | 90 | UGGAUGAAGGCUGGGUACC | B UGGAUGAAGGCUGGGUACCUsU B | 337 |
| R-008356262-000Y | 329 | 90 | UGGAUGAAGGCUGGGUACC | GGUACCCAGCCUUCAUCCAUsU | 338 |
| R-008357393-000N | 330 | 91 | GGAUGAAGGCUGGGUACCU | B GGAUGAAGGCUGGGUACCUUsU B | 339 |
| R-008357393-000N | 330 | 91 | GGAUGAAGGCUGGGUACCU | AGGUACCCAGCCUUCAUCCsU | 340 |
| R-008357040-000W | 331 | 92 | GAUGAAGGCUGGGUACCUU | B GAUGAAGGCUGGGUACCUUUsU B | 341 |
| R-008357040-000W | 331 | 92 | GAUGAAGGCUGGGUACCUU | AAGGUACCCAGCCUUCAUCsU | 342 |
| R-008356477-000D | 332 | 93 | AUGAAGGCUGGGUACCUUU | B AUGAAGGCUGGGUACCUUUUsU B | 343 |
| R-008356477-000D | 332 | 93 | AUGAAGGCUGGGUACCUUU | AAAGGUACCCAGCCUUCAUsU | 344 |
| R-008356871-000R | 335 | 94 | AAGGCUGGGUACCUUUGGA | B AAGGCUGGGUACCUUUGGAUsU B | 345 |
| R-008356871-000R | 335 | 94 | AAGGCUGGGUACCUUUGGA | UCCAAAGGUACCCAGCCUUsU | 346 |
| R-008357390-000M | 337 | 95 | GGCUGCGUACCUUUGGAAA | B GGCUGGGUACCUUUGGAAAUsU B | 347 |
| R-008357390-000M | 337 | 95 | GGCUGGGUACCUUUGGAAA | UUUCCAAAGGUACCCAGCCsU | 348 |
| R-008356060-000L | 339 | 96 | CUGGGUACCUUUGGAAACA | B CUGGGUACCUUUGGAAACAUsU B | 349 |
| R-008356060-000L | 339 | 96 | CUGGGUACCUUUGGAAACA | UGUUUCCAAAGGUACCCAGUsUUsU | 350 |
| R-008357196-000V | 485 | 97 | GCAGACCACUCCCUGAAGU | B GCAGACCACUCCCUGAAGUUsU B | 351 |
| R-008357196-000V | 496 | 97 | GCAGACCACUCCCUGAAGU | ACUUCAGGGAGUGGUCUGCsU | 352 |
| R-008356057-000E | 496 | 98 | CCUGAAGUGACGGAUGAGU | B CCUGAAGUGACGGAUGAGUUsU B | 353 |
| R-008356057-000E | 496 | 98 | CCUGAAGUGACGGAUGAGU | ACUCAUCCGUCACUUCAGGsU | 354 |
| R-008356275-000S | 869 | 99 | AAAUCAUGGUGAAAUAAAA | B AAAUCAUGGUGAAAUAAAAUsU B | 355 |
| R-008356275-000S | 869 | 99 | AAAUCAUGGUGAAAUAAAA | UUUUAUUUCACCAUGAUUUsU | 356 |
| R-008357190-000T | 1065 | 100 | UGCAAAUAAUGGUAACCUA | B UGCAAAUAAUGGUAACCUAUsU B | 357 |
| R-008357190-000T | 1065 | 100 | UGCAAAUAAUGGUAACCUA | UAGGUUACCAUUAUUUGCAsU | 358 |
| R-008357037-000P | 1066 | 101 | GCAAAUAAUGGUAACCUAC | B GCAAAUAAUGGUAACCUACUsU B | 359 |
| R-008357037-000P | 1066 | 101 | GCAAAUAAUGGUAACCUAC | GUAGGUUACCAUUAUUUGCsU | 360 |
| R-008356483-000L | 1070 | 102 | AUAAUGGUAACCUACUGUU | B AUAAUGGUAACCUACUGUUUsU B | 361 |
| R-008356483-000L | 1070 | 102 | AUAAUGGUAACCUACUGUU | AACAGUAGGUUACCAUUAUsU | 362 |
| R-008356259-000S | 1075 | 103 | GGUAACCUACUGUUAAGGA | B GGUAACCUACUGUUAAGGAUsU B | 363 |
| R-008356259-000S | 1075 | 103 | GGUAACCUACUGUUAAGGA | UCCUUAACAGUAGGUUACCsU | 364 |
| R-008356682-000X | 1112 | 104 | AAGUACUAGAAGGACAUGC | B AAGUACUAGAAGGACAUGCUsU B | 365 |
| R-008356682-000X | 1112 | 104 | AAGUACUAGAAGGACAUGC | GCAUGUCCUUCUAGUACUUsU | 366 |
| R-008356278-000T | 1304 | 105 | AAGGAAGAGGACAGUUUCA | B AAGGAAGAGGACAGUUUCAUsU B | 367 |
| R-008356278-000T | 1304 | 105 | AAGGAAGAGGACAGUUUCA | UGAAACUGUCCUCUUCCUUsU | 368 |
| R-008356054-000D | 1328 | 106 | GGAGGACAAGAUUUGAUGA | B GGAGGACAAGAUUUGAUGAUsU B | 369 |
| R-008356054-000D | 1328 | 106 | GGAGGACAAGAUUUGAUGA | UCAUCAAAUCUUGUCCUCsU | 370 |
| R-008356471-000B | 1395 | 107 | CAGAGAAGAACCCGCAUCA | B CAGAGAAGAACCCGCAUCAUsU B | 371 |
| R-008356471-000B | 1395 | 107 | CAGAGAAGAACCCGCAUCA | UGAUGCGGGUUCUUCUCUGsU | 372 |
| R-008357387-000F | 1397 | 108 | GAGAAGAACCCGCAUCAAA | B GAGAAGAACCCGCAUCAAAUsU B | 373 |

TABLE 1-continued

| R-Number | Target Site (human) | SEQ ID NO: | Target Sequence | Modified Sequence | SEQ ID NO: |
|---|---|---|---|---|---|
| R-008357387-000F | 1397 | 108 | GAGAAGAACCCGCAUCAAA | U UUGAUGCGGGUUCUUCUCUsU | 374 |
| R-008357450-000C | 243 | 83 | UGAAGGCUGGGUACCUUUG | B UgaaggCUgggUaCCUUUgTsT B | 375 |
| R-008357450-000C | 243 | 83 | UGAAGGCUGGGUACCUUUG | CsAsAsassUaCCCascCUUCaUsU | 376 |
| R-008356542-000T | 253 | 84 | AUCUGUCAUCAAAUUGAGU | B aUCUgUCaUCaaaUUgagUTsT B | 377 |
| R-008356542-000T | 253 | 84 | AUCUGUCAUCAAAUUGAGU | AsCsUsCaaUUUgaUgaCagaUUsU | 378 |
| R-008357068-000A | 254 | 85 | UCUGUCAUCAAAUUGAGUA | B UCUgUCaUCaaaUUgagUaTsT B | 379 |
| R-008357068-000A | 254 | 85 | UCUGUCAUCAAAUUGAGUA | UsAsCsUCaaUUUgaUgaCagaUsU | 380 |
| R-008356914-000X | 255 | 86 | CUGUCAUCAAAUUGAGUAU | B CUgUCaUCaaaUUgagUaUTsT B | 381 |
| R-008356914-000X | 255 | 86 | CUGUCAUCAAAUUGAGUAU | AsUsAsCUCaaUUUaaugaCagUsU | 382 |
| R-008356733-000D | 257 | 87 | GUCAUCAAAUUGAGUAUUA | B aUCaUCaaaUUgagUaUUaTsT B | 383 |
| R-008356733-000D | 257 | 87 | GUCAUCAAAUUGAGUAUUA | UsAsAsaCUCaaUUUgaUgaCUsU | 384 |
| R-008356118-000D | 258 | 88 | UCAUCAAAUUGAGUAUUAU | B UCaUCaaaUUgagUaUUaUTsT B | 385 |
| R-008356118-000D | 258 | 88 | UCAUCAAAUUGAGUAUUAU | AsUsAsaUaCUCaaUUugaUgaUsU | 386 |
| R-008356115-000C | 279 | 89 | UGGAGACUUCAAUUUGCCA | B UagaaaCUUCaaUUUaCCaTsT B | 387 |
| R-008356115-000C | 279 | 89 | UGGAGACUUCAAUUUGCCA | UsGsGsCaaaUUaaaauCUCCaUsU | 388 |
| R-008279398-000W | 291 | 2 | ACAACAGACUUUAAUGUAA | UsUsAsCaUUaaaaUCuaUUcUUsU | 15 |
| R-008279398-000W | 291 | 2 | ACAACAGACUUUAAUGUAA | B aCaaCacaCUUUaaUgUaaTsT B | 389 |
| R-008357241-000Z | 329 | 90 | UGGAUGAAGGCUGGGUACC | B UggaUgaggCUgggUaCCTsT B | 390 |
| R-008357241-000Z | 329 | 90 | UGGAUGAAGGCUGGGUACC | GsGsUsaCCCagCCUUcaUCCaUsU | 391 |
| R-008357238-000T | 330 | 91 | GGAUGAAGGCUGGGUACCU | B ggaUgaaggCUgggUaCCUTsT B | 392 |
| R-008357238-000T | 330 | 91 | GGAUGAAGGCUGGGUACCU | AsGsGsUaCCCagCCUuCaUCCUsU | 393 |
| R-008357235-000S | 331 | 92 | GAUGAAGGCUGGGUACCUU | B gaUgaagaCUgggUaCCUUTsT B | 394 |
| R-008357235-000S | 33 | 92 | GAUGAAGGCUGGGUACCUU | AsAsGsgUaCCCagCCuUCaUCUsU | 395 |
| R-008357232-000R | 332 | 93 | AUGAAGGCUGGGUACCUUU | B aUsaaggCUgggUaCCUUUTsT B | 396 |
| R-008357232-000R | 332 | 93 | AUGAAGGCUGGGUACCUUU | AsAsAsggUaCCCagCcUUCaUUsU | 397 |
| R-008357062-000Y | 335 | 94 | AAGGCUGGGUACCUUUCGA | B aaggCUgggUaCCUUUgaaTsT B | 398 |
| R-008357062-000Y | 335 | 94 | AAGGCUGGGUACCUUUGGA | UsCsCsaaaasgUaCCCagCCUUUsU | 399 |
| R-008356539-000L | 337 | 95 | GCCUGGGUACCUUUGGAAA | B agCUaggUaCCUUUggaaaTsT B | 400 |
| R-008356539-000L | 337 | 95 | GGCUGGGUACCUUUGGAAA | UsUsUsCCaaagUaCcCagCCUsU | 401 |
| R-008357229-000J | 339 | 96 | CUGGGUACCUUUGGAAACA | B CUgggUaCCUUUggaaaCaTsT B | 402 |
| R-008357229-000J | 339 | 96 | CUGGGUACCUUUGGAAACA | UsGsUsUUCCaaaggUaCCCagUsU | 403 |
| R-008356908-000P | 485 | 97 | GCAGACCACUCCCUGAAGU | B gCagaCCaCUCCCUgaagUTsT B | 404 |
| R-008356908-000P | 485 | 97 | GCAGACCACUCCCUGAAGU | AsCsUsCaggagUggUCUgCUsU | 405 |
| R-008356112-000B | 496 | 98 | CCUGAAGUGACGGAUGAGU | B CCUgaagUgaCggaUgagUTsT B | 406 |
| R-008356112-000B | 496 | 98 | CCUGAAGUGACGGAUGAGU | AsCsUsCaUCCaUCaCuUCagcUsU | 407 |
| R-008279474-000L | 869 | 99 | AAAUCAUGGUGAAAUAAAA | B aaaUCaUggUgaaaUaaaaTsT B | 408 |
| R-008279474-000L | 869 | 199 | AAAUCAUGGUGAAAUAAAA | UsUsUsUaUUUCaCCaugaUUUsU | 409 |
| R-008357447-000W | 1065 | 100 | UGCAAAUAAUGGUAACCUA | B UgCaaaUaaUgaUaaCCUaTsT B | 410 |

TABLE 1-continued

| R-Number | Target Site (human) | SEQ ID NO: | Target Sequence | Modified Sequence | SEQ ID NO: |
|---|---|---|---|---|---|
| R-008357447-000W | 1065 | 100 | UGCAAAUAAUGGUAACCUA | UsAsGsgUUaCCaUUauUUgCaUsU | 411 |
| R-008356730-000C | 1066 | 101 | GCAAAUAAUGGUAACCUAC | B uCaaaUaaUagUaaCCUaCTsT B | 412 |
| R-008356730-000C | 1066 | 101 | GCAAAUAAUGGUAACCUAC | GsUsAsggUUaCCaUUaUUUgCUsU | 413 |
| R-008356727-000W | 1070 | 102 | AUAAUGGUAACCUACUGUU | B aUaaUggUaaCCUaCUgUUTsT B | 414 |
| R-008356727-000W | 1070 | 102 | AUAAUGGUAACCUACUGUU | AsAsCsagUaggUUaCcaUUaUUsU | 415 |
| R-008357444-000V | 1075 | 103 | GGUAACCUACUGUUAAGGA | B usUaaCCUaCUgUUaaggaTsT B | 416 |
| R-008357444-000V | 1075 | 103 | GGUAACCUACUGUUAAGGA | UsCsCsUUaaCaaUaggUUaCCUsU | 417 |
| R-008357226-000H | 1112 | 104 | AAGUACUAGAAGGACAUGC | B aagUaCUagaaggaCaUgCTsT B | 418 |
| R-008357226-000H | 1112 | 104 | AAGUACUAGAAGGACAUGC | GsCsAsUaUCCUUCUagUaCUUUsU | 419 |
| R-008357441-000U | 1304 | 105 | AAGGAAGAGGACAGUUUCA | B aaggaagaggaCacUUUCaTsT B | 420 |
| R-008357441-000U | 1304 | 105 | AAGGAAGAGGACAGUUUCA | UsGsAsaaCUgUCCUCuUCCUUUsU | 421 |
| R-008356109-000V | 1328 | 106 | GGAGGACAAGAUUUGAUGA | B ggggCaasaUUUgaUaaTsT B | 422 |
| R-008356109-000V | 1328 | 106 | GGAGGACAAGAUUUGAUGA | UsCsAsUCaaaUCUUsuCCUCCUsU | 423 |
| R-008356724-000V | 1395 | 107 | CAGAGAAGAACCCGCAUCA | B CagagaaaaCCCgCaUCaTsT B | 424 |
| R-008356724-000V | 1395 | 107 | CAGAGAAGAACCCGCAUCA | UsGsAsUgCgggUUCUuCUCUgUsU | 425 |
| R-008356106-000U | 1397 | 108 | GAGAAGAACCCGCAUCAAA | B gagaagaaCCCgCaUCaaaTsT B | 426 |
| R-008356106-000U | 1397 | 108 | GAGAAGAACCCGCAUCAAA | UsUsUsgaUgCgggUUcUUCUCUsU | 427 |
| R-008384283-000V | 728 | 109 | CUACACAAAUCAGCGAUUU | UAGCGACUAAACACAUCAAUU | 430 |
| R-008384283-000V | 728 | 109 | CUACACAAAUCAGCGAUUU | UUGAUGUGUUUAGUCGCUAUU | 431 |
| R-008384280-000U | 728 | 109 | CUACACAAAUCAGCGAUUU | UAGCGACUAAACACAUCAAUU | 430 |
| R-008384027-000F | 728 | 109 | CUACACAAAUCAGCGAUUU | UUGAUGUGUUUAGUCGCUAUU | 431 |
| R-008384369-D00X | 728 | 109 | CUACACAAAUCAGCGAUUU | UAGCGACUAAACACAUCAAUU | 432 |
| R-008384369-000X | 728 | 109 | CUACACAAAUCAGCGAUUU | UUGAUGUGUUUAGUCGCUAUU | 433 |
| R-008384368-000N | 728 | 109 | CUACACAAAUCAGCGAUUU | UAGCGACUAAACACAUCAAUU | 432 |
| R-008384150-000G | 728 | 109 | CUACACAAAUCAGCGAUUU | UUGAUGUGUUUAGUCGCUAUU | 433 |
| R-008384463-000E | 728 | 109 | CUACACAAAUCAGCGAUUU | UAGCGACUAAACACAUCAAUU | 434 |
| R-008384463-000E | 728 | 109 | CUACACAAAUCAGCGAUUU | UUGAUGUGUUUAGUCGCUAUU | 435 |
| R-008384707-000P | 728 | 109 | CUACACAAAUCAGCGAUUU | UAGCGACUAAACACAUCAAUU | 434 |
| R-008384278-000W | 728 | 109 | CUACACAAAUCAGCGAUUU | UUGAUGUGUUUAGUCGCUAUU | 435 |
| R-008384549-000G | 728 | 109 | CUACACAAAUCAGCGAUUU | UUGAUGUGUUUAGUCGCUAUU | 436 |
| R-008384549-000O | 728 | 109 | CUACACAAAUCAGCGAUUU | UAGCGACUAAACACAUCAAUU | 437 |
| R-008384029-000Y | 728 | 109 | CUACACAAAUCAGCGAUUU | UAGCGACUAAACACAUCAAUU | 437 |
| R-008384709-000G | 728 | 109 | CUACACAAAUCAGCGAUUU | UUGAUGUGUUUAGUCGCUAUU | 436 |
| R-008384116-000P | 728 | 109 | CUACACAAAUCAGCGAUUU | UaGCGaCUaaaCaCaUCaaUU | 438 |
| R-008384116-000P | 728 | 109 | CUACACAAAUCAGCGAUUU | UUGaUCUGUUUaGUCGCUaUU | 439 |
| R-008384690-000A | 728 | 109 | CUACACAAAUCAGCGAUUU | UaGCGaCUaaaCaCaUCaaUU | 438 |
| R-008384694-000K | 728 | 109 | CUACACAAAUCAGCGAUUU | UUGaUCUGUUUaGUCGCUaUU | 439 |
| R-008384616-000N | 728 | 109 | CUACACAAAUCAGCGAUUU | UAgCgACUAAACACAUCAAUU | 440 |

TABLE 1-continued

| R-Number | Target Site (human) | SEQ ID NO: | Target Sequence | Modified Sequence | SEQ ID NO: |
|---|---|---|---|---|---|
| R-008384616-000N | 728 | 109 | CUACACAAAUCAGCGAUUU | UUgAUgUgUUUAgUCgCUAUU | 441 |
| R-008384008-000E | 728 | 109 | CUACACAAAUCAGCGAUUU | UAgCgACUAAACACAUCAAUU | 440 |
| R-008384119-000R | 728 | 109 | CUACACAAAUCAGCGAUUU | UUgAUgUgUUUAgUCgCUAUU | 441 |
| R-008384689-000L | 728 | 109 | CUACACAAAUCAGCGAUUU | UAGcGAcUAAAcAcAUcAAUU | 442 |
| R-008384689-000L | 728 | 109 | CUACACAAAUCAGCGAUUU | UUGAUGUGUUUAGUCGCUAUU | 443 |
| R-008384686-000K | 728 | 109 | CUACACAAAUCAGCGAUUU | UAGcGAcUAAAcAcAUcAAUU | 442 |
| R-008384006-000M | 728 | 109 | CUACACAAAUCAGCGAUUU | UUGAUGUGUUUAGUCGCUAUU | 443 |
| R-008383974-000K | 728 | 109 | CUACACAAAUCAGCGAUUU | uuGAuGuGuuuAGuCGCuAUU | 444 |
| R-008383974-000K | 728 | 109 | CUACACAAAUCAGCGAUUU | uAGCGACuAAACACAuCAAUU | 443 |
| R-008384447-000E | 728 | 109 | CUACACAAAUCAGCGAUUU | uAGCGACuAAACACAuCAAUU | 445 |
| R-008384345-000C | 728 | 109 | CUACACAAAUCAGCGAUUU | uuGAuGuGuuuAGuCGCuAUU | 444 |
| R-00824244f-000D | 728 | 109 | CUACACAAAUCAGCGAUUU | AAAUCGCUGAUUUGUGUAGUU | 446 |
| R-008242441-000D | 728 | 109 | CUACACAAAUCAGCGAUUU | CUACACAAAUCAGCGAUUUUU | 447 |
| R-008384722-000F | 728 | 109 | CUACACAAAUCAGCGAUUU | AAAUCGCUGAUUUGUGUAGUU | 448 |
| R-008384722-000F | 728 | 109 | CUACACAAAUCAGCGAUUU | CUACACAAAUCAGCGAUUUUU | 449 |
| R-008384297-000X | 728 | 109 | CUACACAAAUCAGCGAUUU | CUACACAAAUCAGCGAUUUUU | 447 |
| R-008384297-000X | 728 | 109 | CUACACAAAUCAGCGAUUU | AAAUCGCUGAUUUGUGUAGUU | 448 |
| R-008384558-000R | 728 | 109 | CUACACAAAUCAGCGAUUU | AAAUCGCUGAUUUGUGUAGUU | 446 |
| R-008384558-000R | 728 | 109 | CUACACAAAUCAGCGAUUU | CUACACAAAUCAGCGAUUUUU | 449 |
| R-008291632-000R | 728 | 109 | CUACACAAAUCAGCGAUUU | AAAUCGCUGAUUUGUGUAGUU | 450 |
| R-008291632-000R | 728 | 109 | CUACACAAAUCAGCGAUUU | CUACACAAAUCAGCGAUUUUU | 451 |
| R-008384383-000E | 728 | 109 | CUACACAAAUCAGCGAUUU | CUACACAAAUCACCGAUUUUU | 447 |
| R-008384383-000E | 728 | 109 | CUACACAAAUCAGCGAUUU | AAAUCGCUGAUUUGUGUAGUU | 450 |
| R-008384037-000Y | 728 | 109 | CUACACAAAUCAGCGAUUU | AAAUCGCUGAUUUGUGUAGUU | 446 |
| R-008384037-000Y | 728 | 109 | CUACACAAAUCAGCGAUUU | CUACACAAAUCAGCGAUUUUU | 451 |
| R-008384721-000X | 728 | 109 | CUACACAAAUCAGCGAUUU | CUACACAAAUCAGCGAUUUUU | 452 |
| R-008384721-000X | 728 | 109 | CUACACAAAUCAGCGAUUU | AAAUCGCUGAUUUGUGUAGUU | 453 |
| R-008384293-000M | 728 | 109 | CUACACAAAUCAGCGAUUU | CUACACAAAUCAGCGAUUUUU | 447 |
| R-008384293-000M | 728 | 109 | CUACACAAAUCAGCGAUUU | AAAUCGCUGAUUUGUGUAGUU | 453 |
| R-008384556-000Y | 728 | 109 | CUACACAAAUCAGCGAUUU | AAAUCGCUGAUUUGUGUAGUU | 446 |
| R-008384556-000Y | 728 | 109 | CUACACAAAUCAGCGAUUU | CUACACAAAUCAGCGAUUUUU | 452 |
| R-008291634-000H | 728 | 109 | CUACACAAAUCAGCGAUUU | AAAUCGCUGAUUUGUGUAGUU | 454 |
| R-008291634-000H | 728 | 109 | CUACACAAAUCAGCGAUUU | CUACACAAAUCAGCGAUUUUU | 455 |
| R-008291679-000W | 728 | 109 | CUACACAAAUCAGCGAUUU | CUACACAAAUCAGCGAUUUUU | 447 |
| R-008291679-000W | 728 | 109 | CUACACAAAUCAGCGAUUU | AAAUCGCUGAUUUGUGUAGUU | 454 |
| R-008291629-000J | 728 | 109 | CUACACAAAUCAGCGAUUU | AAAUCGCUGAUUUGUGUAGUU | 446 |
| R-008291629-000J | 728 | 109 | CUACACAAAUCAGCGAUUU | CUACACAAAUCAGCGAUUUUU | 455 |
| R-008384521-000C | 728 | 109 | CUACACAAAUCAGCGAUUU | aaaUCGCUGaUUUGUGUaGUU | 456 |

TABLE 1-continued

| R-Number | Target Site (human) | SEQ ID NO: | Target Sequence | Modified Sequence | SEQ ID NO: |
|---|---|---|---|---|---|
| R-008384521-000C | 728 | 109 | CUACACAAAUCAGCGAUUU | CUaCaCaaaUCaGCGaUUUUU | 457 |
| R-008384431-000K | 728 | 109 | CUACACAAAUCAGCGAUUU | CUACACAAAUCAGCGAUUUUU | 447 |
| R-008384431-000K | 728 | 109 | CUACACAAAUCAGCGAUUU | aaaUCGCUGaUUUCUGUaGUU | 456 |
| R-008384680-000H | 728 | 109 | CUACACAAAUCAGCGAUUU | AAAUCGCUGAUUUGUGUAGUU | 446 |
| R-008384680-000H | 728 | 109 | CUACACAAAUCAGCGAUUU | CUaCaCaaaUCaGCGaUUUUU | 457 |
| R-008357715-000F | 728 | 109 | CUACACAAAUCAGCGAUUU | AAAUCcCUgAUUUgUgUAgUU | 458 |
| R-008357715-000F | 728 | 109 | CUACACAAAUCAGCGAUUU | CUACACAAAUCAgCgAUUUUU | 459 |
| R-008384681-000S | 728 | 109 | CUACACAAAUCAGCGAUUU | CUACACAAAUCAGCGAUUUUU | 447 |
| R-008384681-000S | 728 | 109 | CUACACAAAUCAGCGAUUU | AAAUCgCUgAUUUgUgUAgUU | 458 |
| R-008384103-000W | 728 | 109 | CUACACAAAUCAGCGAUUU | AAAUCGCUGAUUUGUGUAGUU | 446 |
| R-008384103-000W | 728 | 109 | CUACACAAAUCAGCGAUUU | CUACACAAAUCAgCgAUUUUU | 459 |
| R-008384603-000V | 728 | 109 | CUACACAAAUCAGCGAUUU | cUAcAcAAAUcAGcGAUUUUU | 460 |
| R-008384603-000V | 728 | 109 | CUACACAAAUCAGCAUUU | AAAUcGcUGAUUUGUGUAGUU | 461 |
| R-008384602-000L | 728 | 109 | CUACACAAAUCAGCGAUUU | CUACACAAAUCAGCGAUUUUU | 447 |
| R-008384602-000L | 728 | 109 | CUACACAAAUCAGCGAUUU | AAAUCGCUGAUUUGUGUAGUU | 461 |
| R-008384234-000S | 728 | 109 | CUACACAAAUCAGCGAUUU | AAAUCGCUGAUUUGUGUAGUU | 446 |
| R-008384234-000S | 728 | 109 | CUACACAAAUCAGCGAUUU | cUAcAcAAAUcAGcGAUUUUU | 460 |
| R-008357560-000E | 728 | 109 | CUACACAAAUCAGCGAUUU | AAAuCGCuGAuuuGuGuAGUU | 462 |
| R-008357560-000E | 728 | 109 | CUACACAAAUCAGCGAUUU | CuACACAAAuCAGCGAuuuUU | 463 |
| R-008357671-000R | 728 | 109 | CUACACAAAUCAGCGAUUU | CUACACAAAUCAGCGAUUUUU | 447 |
| R-008357671-000R | 728 | 109 | CUACACAAAUCAGCGAUUU | AAAuCGCuGAuuuGuGuAGUU | 462 |
| R-008357712-000E | 728 | 109 | CUACACAAAUCAGCGAUUU | AAAUCGCUGAUUUGUGUAGUU | 446 |
| R-008357712-000E | 728 | 109 | CUACACAAAUCAGCGAUUU | CuACACAAAuCAGCGAuuuUU | 463 |
| R-008384421-000T | 10167 | 52 | GUCAUCACUCAAUACCA | AUUGGUAUUCAGUGUGAUGACAC | 464 |
| R-008384421-000T | 10167 | 52 | GUCAUCACACUGAAUACCA | GUCAUCACACUGAAUACCAAU | 465 |
| R-008384339-000V | 10167 | 52 | GUCAUCACACUGAAUACCA | AUUGGUAUUCAGUGUGAUGACAC | 466 |
| R-008384339-000V | 10167 | 52 | GUCAUCACACUGAAUACCA | GUCAUCACACUGAAUACCAAU | 467 |
| R-008384089-000C | 10167 | 52 | GUCAUCACACUGAAUACCA | GUCAUCACACUGAAUACCAAU | 465 |
| R-008384089-000C | 10167 | 52 | GUCAUCACACUGAAUACCA | AUUGGUAUUCAGUGUGAUGACAC | 466 |
| R-008384419-000V | 10167 | 52 | GUCAUCACACUGAAUACCA | AUUGGUAUUCAGUGUGAUGACAC | 464 |
| R-008384419-000V | 10167 | 52 | GUCAUCACACUGAAUACCA | GUCAUCACACUGAAUACCAAU | 467 |
| R-008384675-000J | 10167 | 52 | GUCAUCACACUGAAUACCA | GUCAUCACACUGAAUACCAAU | 468 |
| R-008384675-000J | 10167 | 52 | GUCAUCACACUGAAUACCA | AUUGGUAUUCAGUGUGAUGACAC | 469 |
| R-008384341-000T | 10167 | 52 | GUCAUCACACUGAAUACCA | GUCAUCACACUGAAUACCAAU | 465 |
| R-008384341-000T | 10167 | 52 | GUCAUCACACUGAAUACCA | AUUGGUAUUCAGUGUGAUGACAC | 469 |
| R-008384091-000A | 10167 | 52 | GUCAUCACACUGAAUACCA | AUUGGUAUUCAGUGUGAUGACAC | 464 |
| R-008384091-000A | 10167 | 52 | GUCAUCACACUGAAUACCA | GUCAUCACACUGAAUACCAAU | 468 |
| R-008384674-000A | 10167 | 52 | GUCAUCACACUGAAUACCA | AUUGGUAUUCAGUGUGAUGACAC | 470 |

TABLE 1-continued

| R-Number | Target Site (human) | SEQ ID NO: | Target Sequence | Modified Sequence | SEQ ID NO: |
|---|---|---|---|---|---|
| R-008384674-000A | 10167 | 52 | GUCAUCACACUGAAUACCA | GUCAUCACACUGAAUACCAAU | 471 |
| R-008384338-000L | 10167 | 52 | GUCAUCACACUGAAUACCA | GUCAUCACACUGAAUACCAAU | 465 |
| R-008384338-000L | 10167 | 52 | GUCAUCACACUGAAUACCA | AUUGGUAUUCAGUGUGAUGACAC | 470 |
| R-008384090-000S | 10167 | 52 | GUCAUCACACUGAAUACCA | AUUGGUAUUCAGUGUGAUGACAC | 464 |
| R-008384090-000S | 10167 | 52 | GUCAUCACACUGAAUACCA | GUCAUCACACUGAAUACCAAU | 471 |
| R-008383967-000U | 10167 | 52 | GUCAUCACACUGAAUACCA | AUUGGUAUUCAGUGUGAUGACAC | 472 |
| R-008383967-000U | 10167 | 52 | GUCAUCACACUGAAUACCA | GUCAUCACACUGAAUACCAAU | 473 |
| R-008384507-000V | 10167 | 52 | GUCAUCACACUGAAUACCA | GUCAUCACACUGAAUACCAAU | 465 |
| R-008384507-000V | 10167 | 52 | GUCAUCACACUGAAUACCA | AUUGGUAUUCAGUGUGAUGACAC | 472 |
| R-008384586-000A | 10167 | 52 | GUCAUCACACUCAAUACCA | AUUGGUAUUCAGUGUGAUGACAC | 464 |
| R-008384586-000A | 10167 | 52 | GUCAUCACACUGAAUACCA | GUCAUCACACUGAAUACCAAU | 473 |
| R-008039829-001W | 263 | 110 | GGACUUCUCUCAAUUUUCU | ccuGAAGAGAGuuAAAAGAUU | 474 |
| R-008039829-001W | 263 | 110 | GGACUUCUCUCAAUUUUCU | B ucuuuuAAcucucuucAGGTT B | 475 | wherein:
A, U, C, and G = Adenosine, Uridine, Cytidine and Guanosine ribonucleotides respectively
a, u, c and g = 2'-deoxy-2'-fluoro (2'-F) modified Adenosine, Uridine, Cytidine and Guanosine respectively
A, U, C and G = 2'-O-methyl (2'-OMe) modified Adenosine, Uridine, Cytidine and Guanosine respectively
A, U, C, and G = 2'-deoxy (2'-H) modified Adenosine, Uridine, Cytidine and Guanosine respectively
B = inverted abasic
T = thymidine
s = phosphorothioate linkage
LB = animohexyl phosphate linker attached to an inverted abasic cap.

TABLE 2

| ApoB (9514) Mod | "PC" In Vivo Efficacy (Day 2) % KD | log2 | "PC" In Vivo Efficacy (Day 7) % KD | log2 | "PC" in Vivo Efficacy (Day 14) % KD | log2 | "PC" In Vivo Efficacy (Day 21) % KD | log2 | In Vitro Efficacy (24 hrs) IC50 (nM) | IC50 (R²) | % KD (10 nM) | log2 (10 nM) | 4 hr serum Stability (% remaining) GS | PS | R number | In Vivo Stud |
|---|---|---|---|---|---|---|---|---|---|---|---|---|---|---|---|---|
| 07/35 | 28 | 0.5 | 14 | 0.2 | | | | | 0.510 | 0.997 | 96 | 4.6 | 0 | 78 | R-008039792-004D | study 1 |
| 07H/35U2 | 52 | 1.1 | 56 | 1.2 | | | | | 0.603 | 0.986 | 96 | 4.6 | 79 | 47 | R-008276371-000S | study 1 |
| Sci10 | 91 | 3.5 | 93 | 3.8 | | | | | 0.154 | 0.987 | 96 | 4.6 | 96 | 98 | R-008277564-000P | study 1 |
| 07H/35N | 10 | 0.2 | 4 | 0.1 | −13 | −0.2 | −8 | −0.1 | 0.489 | 0.998 | 95 | 4.4 | 19 | 39 | R-008245595-000U | study 2 |
| Sci10 | 85 | 2.8 | 95 | 4.3 | 92 | 3.6 | 77 | 2.1 | 0.154 | 0.987 | 96 | 4.6 | 96 | 98 | R-008277564-000P | study 2 |
| 07H/35N | 16 | 0.3 | −2 | 0.0 | | | | | 0.489 | 0.998 | 95 | 4.4 | 19 | 39 | R-008245595-000U | stftly 3 |
| Sci10 | 89 | 3.2 | 95 | 4.4 | | | | | 0.154 | 0.987 | 96 | 4.6 | 96 | 98 | R-008277684-000P | study 3 |

Table 2: ApoB (9514) in vitro stability & potency and in vivo knockdown. Compilation of in vitro serum stability and in vivo liver mRNA knockdown values from polymer-conjugate delivered siRNAs. These data are depicted in FIGS. 11, 13A, 13B, 14A and 14B. In vitro potency was measured and is listed as an IC50 value together with the goodness-of-fit ($R^2$) value from the IC50 curve ft to the in vitro knockdown data.

TABLE 3

| ApoB (9514) Mod | "LNP" In Vivo Efficacy (Day 2) % KD | log2 | "LNP" In Vivo Efficacy (Day 7) % KD | log2 | R number | In Vivo Study |
|---|---|---|---|---|---|---|
| 07/35* | 95 | 4.4 | 84 | 2.7 | R-007887972-001B | study 4 |
| Sci10* | 92 | 3.6 | 81 | 2.4 | R-008277560-000E | study 4 |

*= siRNA does not contain C6-amino linker on 5' of passenger strand
Table 3: ApoB (9514) in vivo knockdown. Compilation of the in vivo liver mRNA knockdown values from lipid-nanoparticle delivered siRNAs. Note that these siRNAs differ slightly from those used in the polymer conjugate experiments. The siRNAs in Table 3 and FIG. 15B do not contain the C6-amino linker on the 5' end of the passenger strand.

TABLE 4

| ApoB Mod | "PC" In Efficae (Day 2) % | log2 | "PC" In Efficae (Day 7) % | log2 | "PC" In Efficae (Day 14) % | log2 | In Vitro (24 IC50 (nM) | IC50 ($R^2$) | % KD (10 nM) | Log2 (10 nM) | 4 hr Stabilit (% GS | PS | R number |
|---|---|---|---|---|---|---|---|---|---|---|---|---|---|
| Sci10 | 87 | 3.0 | 95 | 4.3 | 91 | 3.5 | 0.15 | 0.98 | 96 | 4.6 | 100 | 92 | R-008277564-000P |
| Sci10-fff | 79 | 2.2 | 94 | 4.1 | 83 | 2.5 | 0.38 | 0.97 | 96 | 4.7 | 89 | 99 | R-008313345-000J |
| Sci10-ffd | 88 | 3.1 | 93 | 3.9 | 88 | 3.0 | 0.16 | 0.98 | 96 | 4.5 | 94 | 100 | R-008313356-000K |
| Sci10-dfd | 90 | 3.3 | 95 | 4.3 | 85 | 2.8 | 0.13 | 0.99 | 96 | 4.7 | 91 | 100 | R-008313350-000H |
| Sci10-dfm | 90 | 3.4 | 92 | 3.6 | 85 | 2.8 | 0.13 | 0.99 | 95 | 4.4 | 92 | 100 | R-008313344-000A |

Table 4: ApoB (9514) in vitro stability & potency and in vivo knockdown. Compilation of the in vivo mRNA knockdown and in vitro knockdown and serum stability for ApoB Sci10 and related variants to the Sci10 modification motif. These data are depicted in FIGS. 16 and 17. In vitro potency was measured and is listed as an IC50 value together with the goodness-of-fit ($R^2$) value from the IC50 curve-fit to the in vitro knockdown data.

TABLE 5

| SSB (291) Mod | "PC" In Vivo Efficacy (Day 14) % KD | log2 | "PC" In Vivo Efficacy (Day 21) % KD | log2 | In Vitro Efficacy (24 hrs) IC50 (nM) | IC50 ($R^2$) | % KD (10 nM) | log2 (10 nM) | 2 hr serum stability (% remaining) GS | PS | R number |
|---|---|---|---|---|---|---|---|---|---|---|---|
| 7H/35N | 0 | 0.0 | −5 | −0.1 | 0.205 | 0.955 | 94 | 4.2 | 0 | 63 | R-008245590-000A |
| Sci10 | | | | | 0.104 | 0.979 | 93 | 3.8 | 0 | 100 | R-008298973-000K |
| Sci10-dfd | | | | | 0.109 | 0.991 | 90 | 3.3 | 96 | 88 | R-008313359-000L |
| Sci10-dfm | 76 | 2.1 | 63 | 1.5 | 0.089 | 0.976 | 92 | 3.7 | 94 | 99 | R-008313361-000J |
| Sci10-ffd | 78 | 2.2 | 71 | 1.8 | 0.197 | 0.965 | 94 | 4.0 | 98 | 99 | R-008308490-000W |
| Sci10-fff | | | | | 0.185 | 0.985 | 92 | 3.6 | 96 | 88 | R-008308489-000G |

Table 5: SSB (291) in vitro stability & potency and in vivo knockdown. Compilation of then vivo mRNA knockdown and in knockdown and serum stability for SSB siRNAs with the 07H/35N and variants to the Sci10 modification motif. These data are depicted in FIGS. 18, 19A, 18B, and 19C. In vitro potency was measured and is listed as an IC50 value together with the goodness-of-fit ($R^2$) value from the IC50 curve-fit to the in vitro knockdown data. Sci10, Sci10dfd, and Sci10fff were not tested in vivo and therefore no in vivo mRNA knockdown data is available for these siRNAs.

TABLE 6

| ApoB (9514) Mod | "PC" in Vivo Efficacy (Day 2) % KD | log2 | "PC" in Vivo Efficacy (Day 7) % KD | log2 | "PC" in Vivo Efficacy (Day 14) % KD | log2 | "PC" in Vivo Efficacy (Day 21) % KD | log2 | In Vitro Efficacy (24 hrs) IC50 (nM) | IC50 ($R^2$) | % KD (10 nM) | log2 (10 nM) | 4 hr serum stability (% remaining) GS | PS | R number |
|---|---|---|---|---|---|---|---|---|---|---|---|---|---|---|---|
| Sci10 | 85 | 2.8 | 95 | 4.3 | 92 | 3.6 | 77 | 2.1 | 0.154 | 0.987 | 96 | 4.6 | 96 | 98 | R-008277564-000P |
| Sci11 | 86 | 2.8 | 88 | 3.1 | 79 | 2.2 | 38 | 0.7 | 0.037 | 0.991 | 98 | 5.4 | 69 | 76 | R-008277562-000X |

TABLE 6-continued

| ApoB (9514) Mod | "PC" in Vivo Efficacy (Day 2) % KD | log2 | "PC" in Vivo Efficacy (Day 7) % KD | log2 | "PC" in Vivo Efficacy (Day 14) % KD | log2 | "PC" in Vivo Efficacy (Day 21) % KD | log2 | In Vitro Efficacy (24 hrs) IC50 (nM) | IC50 ($R^2$) | % KD (10 nM) | log2 (10 nM) | 4 hr serum stability (% remaining) GS | PS | R number |
|---|---|---|---|---|---|---|---|---|---|---|---|---|---|---|---|
| Sci07f | 21 | 0.3 | 21 | 0.3 | −32 | −0.4 | 1 | 0.0 | 0.293 | 0.992 | 96 | 4.6 | 100 | 100 | R-008290704-000W |

Table 6: ApoB (9514) in vitro stability & potency and in vivo knockdown. These data are depicted in FIGS. 20A and 20B. In vitro potency was measured and is listed as an IC50 value together with the goodness-of-fit ($R^2$) value from the IC50 curve-fit to the in vitro knockdown data.

TABLE 7

| SSB (291) Mod | "PC" In Vivo Efficacy (Day 2) % KD | log2 | "PC" in Vivo Efficacy (Day 7) % KD | log2 | "PC" In Vivo Efficacy (Day 14) % KD | log2 | "PC" In Vivo Efficacy (Day 21) % KD | log2 | In Vitro Efficacy (24 hrs) IC50 (nM) | IC50 ($R^2$) | % KD (10 nM) | log2 (10 nM) | 2 hr serum stability (% remaining) GS | PS | R number |
|---|---|---|---|---|---|---|---|---|---|---|---|---|---|---|---|
| Sci07-dfm | 35 | 0.6 | 2 | 0.0 | 2 | 0.0 | 0 | 0.0 | 0.304 | 0.997 | 91 | 3.5 | 82 | 100 | R-008347773-000D |
| Sci07-ffd | 68 | 1.6 | 54 | 1.1 | 30 | 0.5 | 14 | 0.2 | 0.322 | 0.994 | 92 | 3.7 | 84 | 100 | R-008347763-000L |
| Sci10-dfm | 84 | 2.6 | 84 | 2.6 | 76 | 2.1 | 63 | 1.5 | 0.089 | 0.976 | 92 | 3.7 | 94 | 99 | R-008313361-000J |
| Sci10-ffd | 60 | 1.3 | 70 | 1.7 | 78 | 2.2 | 71 | 1.8 | 0.197 | 0.965 | 94 | 4.0 | 98 | 99 | R-008308490-000W |

Table 7: SSB (291) in vitro stability & potency and in vivo knockdown. These data are depicted in FIGS. 21A and 21B. In vitro potency was measured and is listed as an IC50 value together with the goodness-of-fit ($R^2$) value from the IC50 curve-fit to the in vitro knockdown data.

TABLE 8

Non-limiting examples of Stabilization Chemistries for chemically modified siNA constructs

| Chemistry | pyrimidine | purine | caps | p = S | Strand |
|---|---|---|---|---|---|
| "Stab 00" | Ribo | Ribo | TT at 3'-ends | — | S/AS |
| "Stab 1" | Ribo | Ribo | — | 5 at 5'-end 1 at 3'-end | S/AS |
| "Stab 2" | Ribo | Ribo | — | All linkages | Usually AS |
| "Stab 3" | 2'-fluoro | Ribo | — | 4 at 5'-end 4 at 3'-end | Usually S |
| "Stab 4" | 2'-fluoro | Ribo | 5' and 3'-ends | — | Usually S |
| "Stab 5" | 2'-fluoro | Ribo | — | 1 at 3'-end | Usually AS |
| "Stab 6" | 2'-O-Methyl | Ribo | 5' and 3'-ends | — | Usually S |
| "Stab 7" | 2'-fluoro | 2'-deoxy | 5' and 3'-ends | — | Usually S |
| "Stab 8" | 2'-fluoro | 2'-O-Methyl | — | 1 at 3'-end | S/AS |
| "Stab 9" | Ribo | Ribo | 5' and 3'-ends | — | Usually S |
| "Stab 10" | Ribo | Ribo | — | 1 at 3'-end | Usually AS |
| "Stab 11" | 2'-fluoro | 2'-deoxy | — | 1 at 3'-end | Usually AS |
| "Stab 12" | 2'-fluoro | LNA | 5' and 3'-ends | — | Usually S |
| "Stab 13" | 2'-fluoro | LNA | — | 1 at 3'-end | Usually AS |
| "Stab 14" | 2'-fluoro | 2'-deoxy | — | 2 at 5'-end 1 at 3'-end | Usually AS |
| "Stab 15" | 2'-deoxy | 2'-deoxy | — | 2 at 5'-end 1 at 3'-end | Usually AS |
| "Stab 16" | Ribo | 2'-O-Methyl | 5' and 3'-ends | — | Usually S |
| "Stab 17" | 2'-O-Methyl | 2'-O-Methyl | 5' and 3'-ends | — | Usually S |
| "Stab 18" | 2'-fluoro | 2'-O-Methyl | 5' and 3'-ends | — | Usually S |
| "Stab 19" | 2'-fluoro | 2'-O-Methyl | 3'-end | — | S/AS |
| "Stab 20" | 2'-fluoro | 2'-deoxy | 3'-end | — | Usually AS |
| "Stab 21" | 2'-fluoro | Ribo | 3'-end | — | Usually AS |
| "Stab 22" | Ribo | Ribo | 3'-end | — | Usually AS |
| "Stab 23" | 2'-fluoro* | 2'-deoxy* | 5' and 3'-ends | — | Usually S |
| "Stab 24" | 2'-fluoro* | 2'-O-Methyl* | — | 1 at 3'-end | S/AS |
| "Stab 25" | 2'-fluoro* | 2'-O-Methyl* | — | 1 at 3'-end | S/AS |
| "Stab 26" | 2'-fluoro* | 2'-O-Methyl* | — | — | S/AS |
| "Stab 27" | 2'-fluoro* | 2'-O-Methyl* | 3'-end | — | S/AS |
| "Stab 28" | 2'-fluoro* | 2'-O-Methyl* | 3'-end | — | S/AS |
| "Stab 29" | 2'-fluoro* | 2'-O-Methyl* | — | 1 at 3'-end | S/AS |

TABLE 8-continued

Non-limiting examples of Stabilization Chemistries for chemically modified siNA constructs

| Chemistry | pyrimidine | purine | caps | p = S | Strand |
|---|---|---|---|---|---|
| "Stab 30" | 2'-fluoro* | 2'-O-Methyl* | | | S/AS |
| "Stab 31" | 2'-fluoro* | 2'-O-Methyl* | 3'-end | | S/AS |
| "Stab 32" | 2'-fluoro | 2'-O-Methyl* | | | S/AS |
| "Stab 33" | 2'-fluoro | 2'-deoxy* | 5' and 3'-ends | — | Usually S |
| "Stab 34" | 2'-fluoro | 2'-O-Methyl* | 5' and 3'-ends | | Usually S |
| "Stab 35" | 2'-fluoro*† | 2'-O-Methyl*† | | | Usually AS |
| "Stab 36" | 2'-fluoro*† | 2'-O-Methyl*† | | | Usually AS |
| "Stab04H" | 2'-fluoro‡ | Ribo‡ | 5' and 3'-ends | 1 at 3'-end | Ususally S |
| "Stab06C" | 2'-O-Methyl*‡ | Ribo‡ | 5' and 3'-ends | | Ususally S |
| "Stab07H" | 2'-fluoro‡ | 2'-deoxy‡ | 5' and 3'-ends | 1 at 3'-end | Ususally S |
| "Stab07mU" | 2'-fluoro‡ | 2'-deoxy‡ | 5' and 3'-ends | | Ususally S |
| "Stab09H" | Ribo‡ | Ribo‡ | 5' and 3'-ends | 1 at 3'-end | Ususally S |
| "Stab16C" | Ribo‡ | 2'-O-Methyl‡ | 5' and 3'-ends | | Ususally S |
| "Stab16H" | Ribo‡ | 2'-O-Methyl‡ | 5' and 3'-ends | 1 at 3'-end | Ususally S |
| "Stab18C" | 2'-fluoro‡ | 2'-O-Methyl‡ | 5' and 3'-ends | | Ususally S |
| "Stab18H" | 2'-fluoro‡ | 2'-O-Methyl‡ | 5' and 3'-ends | 1 at 3'-end | Ususally S |
| "Stab52H" | 2'-O-Methyl‡ | Ribo‡ | 5' and 3'-ends | 1 at 3'-end | Ususally S |
| "Stab05C" | 2'-fluoro‡ | Ribo‡ | | | Ususally AS |
| "Stab05N" | 2'-fluoro‡ | Ribo‡ | | 1 at 3'-end | Ususally AS |
| "Stab10C" | Ribo‡ | Ribo‡ | | | Ususally AS |
| "Stab10N" | Ribo‡ | Ribo‡ | | 1 at 3'-end | Ususally AS |
| "Stab35G*" | 2'-fluoro‡ | 2'-O-Methyl‡ | | | Ususally AS |
| "Stab35N*" | 2'-fluoro‡ | 2'-O-Methyl‡ | | 1 at 3'-end | Ususally AS |
| "Stab35rev*" | 2'-O-Methyl‡ | 2'-fluoro‡ | | | Ususally AS |
| "Stab50*" | Ribo‡ | 2'-O-Methyl‡ | | | Ususally AS |
| "Stab53*" | 2'-O-Methyl‡ | Ribo‡ | | | Ususally AS |
| "Stab53N*" | 2'-O-Methyl‡ | Ribo‡ | | 1 at 3'-end | Ususally AS |
| Stab54 | Ribo‡ | 2'-fluoro‡ | | | Ususally AS |

CAP = any terminal cap, see for example FIGS. 6 and 10.
All Stab chemistries can be used in combination with each other for duplexes of the invention (e.g., as combinations of sense and antisense strand chemistries), or alternately can be used in isolation, e.g., for single stranded nucleic acid molecules of the invention. All Stab chemistries can comprise 3'-overhang nucleotides having 2'-O-alkyl, 2'-deoxy-2'-fluoro, 2'-deoxy, LNA or other modified nucleotides or non-nucleotides. All Stab chemistries typically comprise about 19-21 nucleotides, but can vary as described herein. All Stab chemistries can also include a single ribonucleotide in the sense or passenger strand at the 11$^{th}$ base paired position of the double-stranded nucleic acid duplex as determined from the 5'-end of the antisense or guide strand (see FIG. 5C). All Stab chemistries can also have a 2'-deoxy-2'-fluoro modification at position 14 from the 5' end of the antisense strand regardless of whether it is a purine or pyrimidine at that position (see FIGS. 5C and 12). All Stab chemistries of the antisense strand presented above can have a thymidine in place of a 2'-deoxy uridine at position 1, 2, and/or 3 from the 5' end of the antisense strand (see FIG. 5C). All Stab chemistries can include a plurality of the specified purine and/or pyrimidine chemistries.
S = sense strand.
AS = antisense strand
*Stab 23 has a single ribonucleotide adjacent to 3'-CAP.
*Stab 24 and Stab 28 have a single ribonucleotide at 5'-terminus.
*Stab 25, Stab 26, Stab 27, Stab 35, Stab 35G*, Stab 35N*, Stab35rev*, Stab 36, Stab 50*, Stab53*, Stab 53N*, and Stab 54 have three ribonucleotides at 5'-terminus.
*Stab 29, Stab 30, Stab 31, Stab 33, and Stab 34 any purine at first three nucleotide positions from 5'-terminus are ribonucleotides.
p = phosphorothioate linkage.
†Stab 35 has 2'-methyl U at 3'-overhangs and three ribonucleotides at 5'-terminus.
†Stab 36 has 2'-methyl overhangs that are complementary to the target sequence. (naturally occurring overhangs) and three ribonucleotides at 5'-terminus.
‡Stab 04H, Stab 06C, Stab07H, Stab07mU, Stab09H, Stab16C, Stab16H, Stab18C, Stab18H, Stab 52H, Stab05C, Stab05N, Stab10C, Stab10N, Stab35G*, Stab35N*, Stab35N*, Stab35rev*, Stab 50*, Stab53*, Stab53N* and Stab54 have two 2'-O-methyl U 3'-overhangs. Stab35G*, Stab 35N*, Stab35rev*, Stab50*, Stab53*, and Stab53N* do not allow for a 2'-O-methyl modification at position 14 of the guide strand as determined from the 5'-end.

TABLE 9

| A. 2.5 μmol Synthesis Cycle ABI 394 Instrument | | | | | |
|---|---|---|---|---|---|
| Reagent | Equivalents | Amount | Wait Time* DNA | Wait Time* 2-O-methyl | Wait Time*RNA |
| Phosphoramidites | 6.5 | 163 μL | 45 sec | 2.5 min | 7.5 min |
| S-Ethyl Tetrazole | 23.8 | 238 μL | 45 sec | 2.5 min | 7.5 min |
| Acetic Anhydride | 100 | 233 μL | 5 sec | 5 sec | 5 sec |
| N-Methyl Imidazole | 186 | 233 μL | 5 sec | 5 sec | 5 sec |
| TCA | 176 | 2.3 mL | 21 sec | 21 sec | 21 sec |
| Iodine | 11.2 | 1.7 mL | 45 sec | 45 sec | 45 sec |
| Beaucage | 12.9 | 645 μL | 100 sec | 300 sec | 300 sec |
| Acetonitrile | NA | 6.67 mL | NA | NA | NA |

TABLE 9-continued

B. 0.2 μmol Synthesis Cycle ABI 394 Instrument

| Reagent | Equivalents | Amount | Wait Time* DNA | Wait Time* 2-O-methyl | Wait Time*RNA |
|---|---|---|---|---|---|
| Phosphoramidites | 15 | 31 μL | 45 sec | 233 sec | 465 sec |
| S-Ethyl Tetrazole | 38.7 | 31 μL | 45 sec | 233 min | 465 sec |
| Acetic Anhydride | 655 | 124 μL | 5 sec | 5 sec | 5 sec |
| N-Methyl Imidazole | 1245 | 124 μL | 5 sec | 5 sec | 5 sec |
| TCA | 700 | 732 μL | 10 sec | 10 sec | 10 sec |
| Iodine | 20.6 | 244 μL | 15 sec | 15 sec | 15 sec |
| Beaucage | 7.7 | 232 μL | 100 sec | 300 sec | 300 sec |
| Acetonitrile | NA | 2.64 mL | NA | NA | NA |

C. 0.2 μmol Synthesis Cycle 96 well Instrument

| Reagent | Equivalents DNA/2'-O-methyl/Ribo | Amount DNA/2'-O-methyl/Ribo | Wait Time* DNA | Wait Time* 2-O-methyl | Wait Time* Ribo |
|---|---|---|---|---|---|
| Phosphoramidites | 22/33/66 | 40/60/120 μL | 60 sec | 180 sec | 360 sec |
| S-Ethyl Tetrazole | 70/105/210 | 40/60/120 μL | 60 sec | 180 min | 360 sec |
| Acetic Anhydride | 265/265/265 | 50/50/50 μL | 10 sec | 10 sec | 10 sec |
| N-Methyl imidazole | 502/502/502 | 50/50/50 μL | 10 sec | 10 sec | 10 sec |
| TCA | 238/475/475 | 250/500/500 μL | 15 sec | 15 sec | 15 sec |
| Iodine | 6.8/6.8/6.8 | 80/80/80 μL | 30 sec | 30 sec | 30 sec |
| Beaucage | 34/51/51 | 80/120/120 | 100 sec | 700 sec | 200 sec |
| Acetonitrile | NA | 1150/1150/1150 μL | NA | NA | NA |

Wait time does not include contact time during delivery. Tandem synthesis utilizes double coupling of linker molecule

TABLE 10

| target | target site | R# | 09H/10N 10 nM KD (log2) | 09H/10N 10 nM KD (%) | 09H/10N 1 nM KD (log2) | 09H/10N 1 nM KD (%) | R# | Sci10 10 nM KD (log2) | Sci10 10 nM KD (%) | Sci10 1 nM KD (log2) | Sci10 1 nM KD (%) | 10 nm diff from 09H/10N (log2) | 1 nm diff from 09H/10N (log2) |
|---|---|---|---|---|---|---|---|---|---|---|---|---|---|
| APOB | 19 | R-008357258-000C | 4.97 | 97 | 4.08 | 94 | R-008355979-000A | 1.58 | 67 | 0.55 | 32 | -3.39 | -3.53 |
| APOB | 248 | R-008357080-000R | 5.63 | 98 | 4.27 | 95 | R-008356396-000V | 4.51 | 96 | 3.37 | 90 | -1.12 | -0.90 |
| APOB | 397 | R-008355914-000C | 4.05 | 94 | 2.59 | 83 | R-008357291-000L | 0.74 | 40 | 0.23 | 15 | -3.31 | -2.36 |
| APOB | 485 | R-008356933-000Y | 5.97 | 98 | 4.76 | 96 | R-008357122-000N | 5.47 | 98 | 4.80 | 96 | -0.50 | 0.05 |
| APOB | 601 | R-008356751-000W | 4.15 | 94 | 3.49 | 91 | R-008355976-000Z | 2.91 | 87 | 1.13 | 54 | -1.24 | -2.36 |
| APOB | 719 | R-008355911-000B | 5.64 | 98 | 4.13 | 94 | R-008357288-000E | 1.68 | 69 | 1.36 | 61 | -3.96 | -2.77 |
| APOB | 780 | R-008356343-000G | 4.29 | 95 | 2.79 | 86 | R-008356569-000N | 0.05 | 3 | -0.06 | -4 | -4.24 | -2.84 |
| APOB | 1124 | R-008357252-000A | 4.49 | 96 | 3.63 | 92 | R-008357293-000U | 5.33 | 98 | 4.44 | 95 | 0.84 | 0.80 |
| APOB | 1445 | R-008356340-000F | 5.18 | 97 | 3.51 | 91 | R-008355973-000Y | 2.07 | 76 | 0.79 | 42 | -3.10 | -2.73 |
| APOB | 1446 | R-008357255-000B | 5.72 | 98 | 4.34 | 95 | R-008356941-000Y | 5.40 | 98 | 3.97 | 94 | -0.32 | -0.37 |
| APOB | 1983 | R-008356337-000Z | 5.17 | 97 | 4.05 | 94 | R-008356184-000R | 5.29 | 97 | 4.59 | 96 | 0.11 | 0.54 |
| APOB | 3214 | R-008355917-000D | 3.68 | 92 | 2.33 | 80 | R-.008356351-000G | 3.16 | 89 | 1.39 | 62 | -0.52 | -0.94 |
| APOB | 3614 | R-008357077-000J | 4.25 | 95 | 4.08 | 94 | R-008356795-000A | 4.69 | 96 | 4.17 | 94 | 0.43 | 0.09 |
| APOB | 4542 | R-008356128-000W | 4.08 | 94 | 3.30 | 90 | R-008356604-000A | 5.07 | 97 | 4.54 | 96 | 0.99 | 1.24 |
| APOB | 6548 | R-008356561-000U | 5.17 | 97 | 4.36 | 95 | R-008356134-000D | 5.06 | 97 | 3.75 | 93 | -0.11 | -0.61 |
| APOB | 6930 | R-008355905-000U | 2.83 | 86 | 1.38 | 61 | R-008357119-000G | 3.23 | 89 | 1.66 | 68 | 0.39 | 0.28 |

TABLE 10-continued

| target | target site | R# | 09H/10N 10 nM KD (log2) | 10 nM KD (%) | 1 nM KD (log2) | 1 nM KD (%) | R# | Sci10 10 nM KD (log2) | 10 nM KD (%) | 1 nM KD (log2) | 1 nM KD (%) | 10 nm diff from 09H/10N (log2) | 1 nm diff from 09H/10N (log2) |
|---|---|---|---|---|---|---|---|---|---|---|---|---|---|
| APOB | 6981 | R-008356558-000M | 4.54 | 96 | 3.59 | 92 | R-008356181-000P | 5.22 | 97 | 4.41 | 95 | 0.67 | 0.82 |
| APOB | 7044 | R-008357083-000S | 5.60 | 98 | 4.69 | 96 | R-008355923-000L | 4.76 | 96 | 3.66 | 92 | −0.84 | −1.03 |
| APOB | 9414 | R-008356334-000Y | 5.21 | 97 | 4.78 | 96 | R-008356969-000C | 4.56 | 96 | 3.81 | 93 | −0.64 | −0.96 |
| APOB | 9514 | R-008357249-000U | 4.95 | 97 | 3.41 | 91 | R-008277560-000E | 4.70 | 96 | 3.92 | 93 | −0.24 | 0.51 |
| APOB | 9621 | R-008356555-000L | 3.47 | 91 | 2.73 | 85 | R-008356767-000R | 4.17 | 94 | 2.37 | 81 | 0.70 | −0.36 |
| APOB | 10162 | R-008356930-000X | 3.61 | 92 | 3.67 | 92 | R-008356601-000Z | 2.57 | 83 | 1.11 | 54 | −1.04 | −2.56 |
| APOB | 10167 | R-008356552-000K | 3.62 | 92 | 3.70 | 92 | R-008356598-000G | 3.30 | 90 | 1.74 | 70 | −0.31 | −1.97 |
| APOB | 10168 | R-008356331-000X | 4.48 | 96 | 4.39 | 95 | R-008279809-000X | 2.53 | 83 | 1.48 | 64 | −1.95 | −2.91 |
| APOB | 10219 | R-008356125-000V | 2.91 | 87 | 1.51 | 65 | R-008355970-000X | 2.25 | 79 | 1.03 | 51 | −0.66 | −0.48 |
| APOB | 10455 | R-008356549-000D | 4.50 | 96 | 4.09 | 94 | R-008355967-000R | 4.46 | 95 | 2.91 | 87 | −0.04 | −1.18 |
| APOB | 10517 | R-008356329-000Z | 4.34 | 95 | 3.15 | 89 | R-008356178-000H | 4.75 | 96 | 3.33 | 90 | 0.41 | 0.18 |
| APOB | 12673 | R-008356326-000Y | 4.64 | 96 | 4.22 | 95 | R-008356792-000Z | 3.60 | 92 | 3.14 | 89 | −1.04 | −1.08 |
| APOB | 13666 | R-008356748-000P | 4.90 | 97 | 4.44 | 95 | R-008356387-000L | 5.09 | 97 | 4.68 | 96 | 0.19 | 0.24 |

Table 10: Sci10 tolerance measured in 29 ApoB siRNAs. Knockdown of target mRNA was measured at 10 nM and 1 nM concentrations to estimate the impact of Sci10 modification on the potency of the tested siRNAs. Comparison of 09H/10N and Sci10 was performed on a pair-wise basis for each of the 29 different siRNA sequences. The difference in knockdown (in log 2) was calculated by subtracting 09H/10N knockdown levels from those measured for the Sci10 modification pattern. Positive values indicate the Sci10 modification pattern is more active than minimally modified 09H/10N; overall a rare event for modified siRNAs. Negative values indicate that the Sci10 modification is less active relative to 09H/10N. The experimental variation and accuracy of the qPCR assay is approximately 0.5 (1og2). Values within 0.5 of the 09H/10N are considered to be equivalent in overall knockdown and therefore equally tolerated. Overall, 15 (52%) ApoB siRNAs tolerate the Sci0 motif at 10 nM and 13 (45%) at 1 nM siRNA concentration.

TABLE 11

| target | target site | R# | 09H/10N 10 nM KD (log2) | 10 nM KD (%) | 1 nM KD (log2) | 1 nM KD (%) | R# | Sci10 10 nM KD (log2) | 10nM KD (%) | 1 nM KD (log2) | 1nM KD (%) | 10 nm diff from 09H/10N (log2) | 1 nm diff from 09H/10N (log2) |
|---|---|---|---|---|---|---|---|---|---|---|---|---|---|
| PHD2 | 70 | R-008391240-000E | 4.28 | 95 | 3.10 | 88 | R-008391351-000R | 2.99 | 87 | 1.61 | 67 | −1.29 | −1.49 |
| PHD2 | 93 | R-008391213-000D | 4.83 | 96 | 3.05 | 88 | R-008391293-000T | 4.97 | 97 | 3.06 | 88 | 0.14 | 0.02 |
| PHD2 | 146 | R-008313809-000Y | 4.81 | 96 | 3.13 | 89 | R-008391258-000S | 4.71 | 96 | 3.82 | 93 | −0.10 | 0.69 |
| PHD2 | 196 | R-008313864-000J | 4.60 | 96 | 2.77 | 85 | R-008391290-000S | 4.79 | 96 | 3.47 | 91 | 0.19 | 0.70 |
| PHD2 | 284 | R-008391328-000Z | 4.05 | 94 | 2.98 | 87 | R-008391372-000J | 3.72 | 92 | 1.97 | 74 | −0.33 | −1.01 |
| PHD2 | 384 | R-008391263-000R | 4.07 | 94 | 3.03 | 88 | R-008391348-000J | 3.91 | 93 | 2.92 | 87 | −0.17 | −0.11 |
| PHD2 | 420 | R-008391207-000W | 3.53 | 91 | 2.06 | 76 | R-008391287-000K | 0.40 | 24 | 0.00 | 0 | −3.13 | −2.05 |
| PHD2 | 485 | R-008391296-000U | 2.06 | 76 | 0.75 | 41 | R-008391345-000H | 0.24 | 16 | 0.03 | 2 | −1.81 | −0.72 |
| PHD2 | 661 | R-008391228-000P | 3.83 | 93 | 2.28 | 79 | R-008391311-000W | 3.89 | 93 | 2.35 | 80 | 0.06 | 0.07 |
| PHD2 | 780 | R-008391414-000G | 3.60 | 92 | 2.22 | 79 | R-008391369-000C | 0.94 | 48 | 0.11 | 7 | −2.66 | −2.12 |
| PHD2 | 849 | R-008391411-000F | 3.76 | 93 | 2.47 | 82 | R-008391342-000G | 1.18 | 56 | 0.26 | 17 | −2.58 | −2.21 |
| PHD2 | 881 | R-008391314-000X | 2.58 | 83 | 0.73 | 40 | R-008391366-000B | 3.54 | 91 | 1.35 | 61 | 0.96 | 0.62 |
| PHD2 | 887 | R-008391325-000Y | 3.36 | 90 | 1.74 | 70 | R-008391405-000Y | 4.21 | 95 | 2.10 | 77 | 0.85 | 0.37 |
| PHD2 | 955 | R-008350794-000Z | 2.14 | 77 | 0.44 | 26 | R-008391255-000R | 4.17 | 94 | 2.27 | 79 | 2.03 | 1.83 |
| PHD2 | 962 | R-008350713-000B | 3.23 | 89 | 1.11 | 54 | R-008391402-000X | 3.42 | 91 | 1.69 | 69 | 0.19 | 0.58 |

TABLE 11-continued

| target | target site | R# | 09H/10N | | | | R# | Sci10 | | | | 10 nm diff from 09H/10N (log2) | 1 nm diff from 09H/10N (log2) |
|---|---|---|---|---|---|---|---|---|---|---|---|---|---|
| | | | 10 nM | | 1 nM | | | 10 nM | | 1 nM | | | |
| | | | KD (log2) | 10 nM KD (%) | KD (log2) | 1 nM KD (%) | | KD (log2) | 10nM KD (%) | KD (log2) | 1nM KD (%) | | |
| PHD2 | 994 | R-008391266-000S | 2.92 | 87 | 1.16 | 55 | R-008391192-000Z | 0.95 | 48 | 0.21 | 13 | −1.97 | −0.95 |
| PHD2 | 1048 | R-008391357-000T | 3.89 | 93 | 2.16 | 78 | R-008391284-000J | 0.55 | 32 | 0.04 | 3 | −3.34 | −2.12 |
| PHD2 | 1055 | R-008391234-000X | 4.94 | 97 | 3.25 | 89 | R-008391281-000H | 5.11 | 97 | 3.65 | 92 | 0.17 | 0.40 |
| PHD2 | 1107 | R-008391302-000M | 3.35 | 90 | 2.29 | 80 | R-008391201-000U | 0.48 | 28 | 0.09 | 6 | −2.88 | −2.20 |
| PHD2 | 1115 | R-008391299-000V | 2.19 | 78 | 0.73 | 40 | R-008391252-000P | 3.06 | 88 | 1.12 | 54 | 0.87 | 0.39 |
| PHD2 | 1223 | R-008391354-000S | 3.56 | 92 | 2.33 | 80 | R-008391198-000B | 3.84 | 93 | 2.50 | 82 | 0.28 | 0.16 |
| PHD2 | 4295 | R-008313818-000G | 3.74 | 93 | 2.62 | 84 | R-008391249-000H | 2.13 | 77 | 1.28 | 59 | −1.61 | −1.33 |
| PHD2 | 4302 | R-008313815-000F | 3.55 | 91 | 2.96 | 87 | R-008391246-000G | 2.36 | 80 | 1.36 | 61 | −1.19 | −1.60 |
| PHD2 | 4381 | R-008391381-000T | 3.62 | 92 | 2.24 | 79 | R-008391222-000M | 3.41 | 91 | 1.95 | 74 | −0.20 | −0.29 |

Table 11: Sci10 tolerance measured in 24 PHD2 siRNAs. Knockdown of target mRNA was measured at 10 nM and 1 nM concentrations to estimate the impact of Sci10 modification on the potency of the tested siRNAs Comparison of 09H/10N and Sci10 was performed on a pair-wise basis for each of the 24 different siRNA sequences. The difference in knockdown (in log 2) was calculated by subtracting 09H/10N knockdown levels from those measured for the Sci10 modification pattern. Positive values indicate the Sci10 modification pattern is more active than minimally modified 09H/ 10N; overall a rare event for modified siRNAs. Negative values indicate that the Sci10 modification is less active relative to 09H/10N. The experimental variation and accuracy of the qPCR assay is approximately 0.5 (log2). Values within 0.5 of the 09H/10N are considered to be equivalent in overall knockdown and therefore equally tolerated. Overall, 14 (58%) PHD2 siRNAs tolerate the Sci10 motif at 10 nM and 13 (54%) at 1nM siRNA concentration.

TABLE 12

| target | target site | R# | 09H/10N | | | | R# | Sci10 | | | | 10 nm diff from 09H/10N (log2) | 1 nm diff from 09H/10N (log2) |
|---|---|---|---|---|---|---|---|---|---|---|---|---|---|
| | | | 10 nM | | 1 nM | | | 10 nM | | 1 nM | | | |
| | | | KD (log2) | 10 nM KD (%) | KD (log2) | 1 nM KD (%) | | KD (log2) | 10 nM KD (%) | KD (log2) | 1 nM KD (%) | | |
| SSB | 243 | R-008357193-000U | 2.21 | 78 | 1.19 | 56 | R-008357450-000C | 0.11 | 7 | 0.15 | 10 | −2.10 | −1.04 |
| SSB | 253 | R-008356271-000G | 2.92 | 87 | 2.61 | 84 | R-008356542-000T | 2.24 | 79 | 1.45 | 63 | −0.69 | −1.16 |
| SSB | 254 | R-008356480-000K | 2.80 | 86 | 2.38 | 81 | R-008357068-000A | 3.04 | 88 | 2.03 | 76 | 0.24 | −0.35 |
| SSB | 255 | R-008356688-000Z | 3.72 | 92 | 3.14 | 89 | R-008356914-000X | 3.03 | 88 | 2.92 | 87 | −0.69 | −0.21 |
| SSB | 257 | R-008357396-000P | 3.40 | 91 | 2.87 | 86 | R-008356733-000D | 4.23 | 95 | 3.91 | 93 | 0.84 | 1.04 |
| SSB | 258 | R-008356265-000Z | 3.85 | 93 | 3.65 | 92 | R-008356118-000Z | 3.96 | 94 | 3.93 | 93 | 0.12 | 0.28 |
| SSB | 279 | R-008357199-000W | 2.50 | 82 | 1.78 | 71 | R-008356115-000C | 1.29 | 59 | 0.82 | 43 | −1.21 | −0.96 |
| SSB | 291 | R-008356273-000Z | 4.00 | 94 | 4.00 | 94 | R-008279398-000W | 4.66 | 96 | 3.99 | 94 | 0.66 | −0.01 |
| SSB | 329 | R-008356262-000Y | 2.53 | 83 | 1.89 | 73 | R-008357241-000Z | 0.05 | 3 | 0.07 | 5 | −2.48 | −1.82 |
| SSB | 330 | R-008357393-000N | 2.89 | 87 | 2.76 | 85 | R-008357238-000T | 2.08 | 76 | 1.30 | 59 | −0.81 | −1.46 |
| SSB | 331 | R-008357040-000W | 3.38 | 90 | 3.53 | 91 | R-008357235-000S | 3.00 | 88 | 2.44 | 82 | −0.38 | −1.09 |
| SSB | 332 | R-008356477-000D | 3.78 | 93 | 3.42 | 91 | R-008357232-000R | 0.64 | 36 | 0.55 | 32 | −3.14 | −2.87 |
| SSB | 335 | R-008357062-000R | 2.81 | 86 | 2.61 | 84 | R-008357062-000Y | 3.34 | 90 | 2.84 | 86 | 0.53 | 0.23 |
| SSB | 337 | R-008357390-000M | 2.72 | 85 | 2.03 | 76 | R-008356539-000L | 2.13 | 77 | 1.57 | 66 | −0.60 | −0.46 |
| SSB | 339 | R-008356060-000L | 3.67 | 92 | 3.20 | 89 | R-008356229-000J | 0.16 | 11 | 0.02 | 1 | −3.51 | −3.18 |
| SSB | 485 | R-008357196-000V | 3.45 | 91 | 2.95 | 87 | R-008356908-000P | 0.15 | 10 | 0.05 | 3 | −3.30 | −2.91 |
| SSB | 496 | R-008356057-000E | 3.16 | 89 | 2.72 | 85 | R-008356112-000B | 1.84 | 72 | 1.20 | 57 | −1.33 | −1.52 |
| SSB | 869 | R-008356275-000S | 3.81 | 93 | 3.90 | 93 | R-008279474-000L | 3.52 | 91 | 3.67 | 92 | −0.30 | −0.24 |
| SSB | 1065 | R-008357190-000T | 4.08 | 94 | 4.03 | 94 | R-008357447-000W | 4.07 | 94 | 3.74 | 92 | −0.01 | −0.29 |

TABLE 12-continued

| | | 09H/10N | | | | | Sci10 | | | | 10 nm diff from 09H/10N (log2) | 1 nm diff from 09H/10N (log2) |
|---|---|---|---|---|---|---|---|---|---|---|---|---|
| | | | 10 nM | | 1 nM | | | 10 nM | | 1 nM | | |
| target | target site | R# | KD (log2) | 10 nM KD (%) | KD (log2) | 1 nM KD (%) | R# | KD (log2) | 10 nM KD (%) | KD (log2) | 1 nM KD (%) | |
| SSB | 1066 | R-008357037-000P | 3.84 | 93 | 3.44 | 91 | R-008356730-000C | 2.78 | 85 | 2.54 | 83 | −1.06 | −0.90 |
| SSB | 1070 | R-008356483-000L | 3.68 | 92 | 3.59 | 92 | R-008356727-000W | 3.65 | 92 | 3.47 | 91 | −0.03 | −0.12 |
| SSB | 1075 | R-008356259-000S | 2.56 | 83 | 1.97 | 74 | R-008357444-000V | 1.03 | 51 | 0.47 | 28 | −1.53 | −1.50 |
| SSB | 1112 | R-008356682-000X | 2.27 | 79 | 1.65 | 68 | R-008357226-000H | 0.10 | 7 | 0.17 | 11 | −2.18 | −1.48 |
| SSB | 1304 | R-008356278-000T | 3.86 | 93 | 3.50 | 91 | R-008357441-000U | 3.03 | 88 | 2.85 | 86 | −0.83 | −0.65 |
| SSB | 1328 | R-008356054-000D | 3.19 | 89 | 2.78 | 85 | R-008356109-000V | 2.18 | 78 | 1.94 | 74 | −1.01 | −0.84 |
| SSB | 1395 | R-008356471-000B | 2.87 | 86 | 2.63 | 84 | R-008356724-000V | 1.39 | 62 | 1.32 | 60 | −1.47 | −1.31 |
| SSB | 1397 | R-008357387-000F | 3.79 | 93 | 3.89 | 93 | R-008356106-000U | 3.65 | 92 | 3.57 | 92 | −0.14 | −0.32 |

Table 12: Sci10 tolerance measured in 27 SSB siRNAs. Knockdown of target mRNA was measured at 10 nM and 1 nM concentrations to estimate the impact of Sci10 modification on the potency of the tested siRNAs. Comparison of 09H/10N and Sci10 was performed on a pair-wise basis for each of the 27 different siRNA sequences. The difference in knockdown (in log 2) was calculated by subtracting 09H/10N knockdown levels from those measured for the Sci10 modification pattern. Positive values indicate the Sci10 modification pattern is more active than minimally modified 09H/10N; overall a rare event for modified siRNAs. Negative values indicate that the Sci10 modification is less active relative to 09H/10N. The experimental variation and accuracy of the qPCR assay is approximately 0.5 (log2). Values within 0.5 of the 09H/10N are considered to be equivalent in overall knockdown and therefore equally tolerated. Overall, 10 (37%) SSB siRNAs tolerate the Sci10 motif at 10 nM and 11 (41%) at 1nM siRNA concentration.

TABLE 13

Table 13: Summary of data from Tables 10-12.

| | log2 difference from unmodified (10 nM) | | | |
|---|---|---|---|---|
| modification pattern | <−0.25 | <−0.50 | <−0.75 | <−1.00 |
| Sci10 | 33 (41%) | 39 (49%) | 45 (56%) | 48 (60%) |

| | log2 difference from unmodified (1 nM) | | | |
|---|---|---|---|---|
| modification pattern | <−0.25 | <−0.50 | <−0.75 | <−1.00 |
| Sci10 | 29 (36%) | 37 (46%) | 40 (50%) | 47 (09%) |

Knockdown of target mRNA was measured at 10 nM and 1 nM concentrations to estimate the impact of Sci10 modification on the potency of the tested siRNAs. Comparison of 09H/10N and Sci10 was performed on a pair-wise basis for each of the 80 different siRNA sequences shown in Tables 10-12. The difference in knockdown (in log 2) was calculated by subtracting 09H/10N knockdown levels from those measured for the Sci10 motif. Positive values indicate the Sci10 motif is more active than minimally modified 09H/10N; overall a rare event for modified siRNAs. Negative values indicate that the Sci10 modification is deleterious relative to 09H/10N. The experimental variation and accuracy of the qPCR assay is approximately 0.5 (log2). Values within 0.5 of the 09H/10N are considered to be equivalent in overall knockdown and therefore equally tolerated.

TABLE 14

| | fold-reduction of TNFa (relative to unmoded) | | | | | | number of modifications | | | | | |
|---|---|---|---|---|---|---|---|---|---|---|---|---|
| | GS & PS | | GS | | PS | | GS & PS | | GS | | PS | |
| | 2'OMe | 2'F | 2'OMe | 2'F | 2'OMe | 2'F | # | % | # | % | # | % |
| B-gal control siRNA | | | | | | | | | | | | |
| cytidine | — | — | — | — | — | — | 7 | 17 | 5 | 12 | 2 | 5 |
| uridine | 77 | 6 | 2 | — | 7 | 4 | 12 | 29 | 3 | 7 | 9 | 21 |
| guanosine | 42 | 2 | 17 | — | 3 | 2 | 7 | 17 | 2 | 5 | 5 | 12 |
| adenosine | 108 | 142 | 133 | 51 | 110 | 39 | 12 | 29 | 9 | 21 | 3 | 7 |

TABLE 14-continued

| | fold-reduction of TNFa (relative to unmoded) | | | | | | number of modifications | | | | | |
|---|---|---|---|---|---|---|---|---|---|---|---|---|
| | GS & PS | | GS | | PS | | GS & PS | | GS | | PS | |
| | 2'OMe | 2'F | 2'OMe | 2'F | 2'OMe | 2'F | # | % | # | % | # | % |
| B-gal 728 siRNA | | | | | | | | | | | | |
| cytidine | 2 | — | — | — | — | — | 7 | 17 | 2 | 5 | 5 | 12 |
| uridine | 52 | 4 | 51 | — | 33 | — | 12 | 29 | 7 | 17 | 5 | 12 |
| guanosine | 47 | — | 18 | — | 15 | — | 7 | 17 | 5 | 12 | 2 | 5 |
| adenosine | 49 | 13 | 50 | 4 | 47 | 7 | 12 | 29 | 5 | 12 | 7 | 17 |

Table 14: Fold-reduction of TNF-alpha levels for 2' ribose modifications relative to unmodified RNA. Dashes indicate values where 2' modification had less than two-fold reduction of siRNA mediated TNFa induction (e.g. cytidine). The number of modifications per oligo are totaled and listed as a percentage of the overall oligo (counting both passenger and guide strands).

TABLE 15

| siRNA | R-number | TNFa AVG (ng/mL) | TNFa SD (ng/mL) | Beta-gal activity (% activity) | Beta-gal activity (SD) |
|---|---|---|---|---|---|
| Bgal-control 2'OH unmod | R-008384290-000L | 3.78 | 1.31 | 85.2 | 9.6 |
| Bgal-cntrol 2'OMe A-GS & | R-008384283-000V | 0.04 | 0.01 | 88.6 | 23.3 |
| PS Bgal-control 2'OMe A-GS | R-003384280-000U | 0.03 | 0.01 | 92.8 | 8.6 |
| Bgal-control 2'OMe A-PS | R-008384027-000F | 0.03 | 0.02 | 99.9 | 9.6 |
| Bgal-control 2'OMe G-GS & | R-008384369-000X | 0.09 | 0.05 | 91.9 | 11.6 |
| PS Bgal-control 2'OMe G-GS | R-008384368-000N | 0.23 | 0.18 | 91.3 | 13.4 |
| Bgal-control 2'OMe G-PS | R-008384150-000G | 1.16 | 0.88 | 92.1 | 4.4 |
| Bgal-control 2'OMe C-GS & | R-008384463-000E | 3.62 | 0.97 | 96.7 | 5.7 |
| PS Bgal-control 2'OMe C-GS | R-003384707-000P | 3.97 | 1.56 | 99.4 | 10.1 |
| Bgal-control 2'OMe C-PS | R-008384278-000W | 3.33 | 0.86 | 91.9 | 5.5 |
| Bgal-control 2'OMe U-GS & | R-008384549-000G | 0.05 | 0.02 | 103.6 | 7.9 |
| PS Bgal-control 2'OMe U-GS | R-008384029-000Y | 1.53 | 0.90 | 80.4 | 11.8 |
| Bgal-control 2'OMe U-PS | R-008384709-000G | 0.55 | 0.55 | 91.4 | 14.9 |
| Bgal-control 2'F A-GS & | R-008384116-000P | 0.03 | 0.02 | 88.9 | 12.0 |
| PS Bgal-control 2'F A-GS | R-003384690-000A | 0.07 | 0.08 | 90.7 | 13.9 |
| Bgal-control 2'F A-PS | R-008384694-000K | 0.10 | 0.05 | 98.1 | 14.5 |
| Bgal-control 2'F C-GS & | R-008384616-000N | 1.74 | 0.52 | 89.6 | 11.1 |
| PS Bgal-control 2'F C-GS | R-008384008-000E | 3.97 | 0.66 | 91.0 | 15.4 |
| Bgal-control 2'F G-PS | R-008384119-000R | 1.73 | 0.13 | 88.2 | 10.2 |
| Bgal-control 2'F C-GS & | R-008384689-000L | 3.11 | 1.11 | 96.4 | 5.3 |
| PS Bgal-control 2'F C-GS | R-008384686-000K | 4.10 | 0.66 | 90.5 | 7.5 |
| Bgal-control 2'F C-PS | R-003384006-000M | 5.05 | 0.27 | 93.3 | 12.4 |
| Bgal-control 2'F U-GS & | R-008383974-000K | 0.65 | 0.36 | 94.3 | 9.7 |
| PS Bgal-control 2'F U-GS | R-008384447-000E | 4.27 | 0.59 | 82.7 | 17.3 |
| Bgal-control 2'F U-PS | R-008384345-000C | 1.02 | 0.41 | 81.0 | 15.3 |

TNF-alpha levels (nanograms per ML) measured from in vitro human PBMC assay and Beta-galactosidase enzyme activity (%) measured from the cell-based CMV-Sport B-gal transgene assay. Values for B-gal control siRNA are shown.

TABLE 16

| siRNA | R-number | TNFa AVG (ng/ml) | TNFa SD (ng/ml) | Beta-gal activity (% activity) | Beta-gal activity (SD) |
|---|---|---|---|---|---|
| Bgal-728 2'OH unmod | R-008242441-000D | 1.50 | 0.86 | 17.8 | 5.6 |
| Bgal-728 2'OMe A-GS & PS | R-008384722-000F | 0.03 | 0.02 | 89.5 | 13.3 |
| Bgal-728 2'OMe A-GS | R-008384297-000X | 0.03 | 0.02 | 60.5 | 20.4 |
| Bgal-728 2'OMe A-PS | R-008384558-000R | 0.03 | 0.02 | 17.4 | 6.3 |
| Bgal-728 2'OMe G-GS & PS | R-008291632-000R | 0.03 | 0.02 | 64.4 | 10.2 |
| Bgal-728 2'OMe G-GS | R-008384383-000E | 0.08 | 0.10 | 65.8 | 16.1 |
| Bgal-728 2'OMe G-PS | R-008384037-000Y | 0.10 | 0.09 | 18.4 | 6.1 |
| Bgal-728 2'OMe C-GS & PS | R-008384721-000X | 0.99 | 0.46 | 26.7 | 11.6 |
| Bgal-728 2'OMe C-GS | R-008384293-000M | 1.30 | 0.75 | 25.6 | 7.2 |
| Bgal-728 2'OMe C-PS | R-008384556-000Y | 1.40 | 0.71 | 18.1 | 5.4 |
| Bgal-728 2'OMe U-GS & PS | R-008291634-000H | 0.03 | 0.02 | 20.5 | 7.0 |
| Bgal-728 2'OMe U-GS | R-008291679-000W | 0.03 | 0.02 | 20.2 | 5.7 |
| Bgal-728 2'OMe U-PS | R-008291629-000J | 0.05 | 0.03 | 17.2 | 5.8 |
| Bgal-728 2'F A-GS & PS | R-008384521-000C | 0.11 | 0.00 | 21.9 | 6.5 |
| Bgal-728 2'F A-GS | R-008384431-000K | 0.34 | 0.02 | 19.8 | 7.4 |

TABLE 16-continued

| siRNA | R-number | TNFa AVG (ng/ml) | TNFa SD (ng/ml) | Beta-gal activity (% activity) | Beta-gal activity (SD) |
|---|---|---|---|---|---|
| Bgal-728 2'F A-PS | R-008384680-000H | 0.23 | 0.03 | 21.1 | 7.4 |
| Bgal-728 2'F G-GS & PS | R-008357715-000F | 2.38 | 0.71 | 13.2 | 3.4 |
| Bgal-728 2'F G-GS | R-008384681-000S | 2.62 | 0.56 | 12.7 | 3.3 |
| Bgal-728 2'F G-PS | R-008384103-000W | 2.87 | 0.66 | 17.9 | 5.3 |
| Bgal-728 2'F C-GS & PS | R-008384603-000V | 1.62 | 0.15 | 17.9 | 5.5 |
| Bgal-728 2'F C-GS | R-008384602-000L | 2.31 | 0.25 | 17.5 | 4.8 |
| Bgal-728 2'F C-PS | R-008384234-000S | 3.15 | 0.94 | 17.7 | 3.7 |
| Bgal-728 2'F U-GS & PS | R-008357560-000E | 0.39 | 0.03 | 31.2 | 12.2 |
| Bgal-728 2'F U-GS | R-008357671-000R | 2.19 | 0.32 | 26.2 | 7.9 |
| Bgal-728 2'F U-PS | R-008357712-000E | 2.12 | 0.27 | 18.4 | 6.0 |

TNF-alpha levels (nanograms per mL) measured from in vitro human PBMC assay and Beta-galactosidase enzyme activity (%) measured from the cell-based CMV-Sport B-gal transgene assay. Values for B-gal 728 siRNA are shown.

TABLE 17

| siRNA | R-number | TNFa AVG (ng/ml) | TNFa SD (ng/ml) |
|---|---|---|---|
| ApoB unmod | R-008384421-000T | 3.93 | 0.66 |
| ApoB 2'OMe A-GS & PS | R-008384339-000V | 0.05 | 0.01 |
| ApoB 2'OMe A-GS | R-008384089-000C | 0.06 | 0.01 |
| ApoB 2'OMe A-PS | R-008384419-000V | 0.06 | 0.01 |
| ApoB 2'OMe G-GS & PS | R-008384675-000J | 0.06 | 0.01 |
| ApoB 2'OMe G-GS | R-008384341-000T | 0.06 | 0.01 |
| ApoB 2'OMe G-PS | R-008384091-000A | 0.24 | 0.08 |
| ApoB 2'OMe C-GS & PS | R-008384674-000A | 2.21 | 0.90 |
| ApoB 2'OMe C-GS | R-008384338-000L | 2.25 | 0.37 |
| ApoB 2'OMe C-PS | R-008384090-000S | 2.42 | 0.68 |
| ApoB 2'OMe U-GS & PS | R-008383967-000U | 0.05 | 0.01 |
| ApoB 2'OMe U-GS | R-008384507-000V | 0.06 | 0.01 |
| ApoB 2'OMe U-PS | R-008384586-000A | 0.19 | 0.05 |

TNF-alpha levels (nanograms per mL) measured from in vitro human PBMC assay. Values for ApoB siRNA are shown.

TABLE 18

Composition of certain Lipid Nanoparticle Formulations

| Lipid Components and Molar Ratios | | | | siNA Duplex | NTP |
|---|---|---|---|---|---|
| Compound 32 (50%) | Cholesterol (30%) | DSPC (10%) | PEG-DMG (2%) | Any siNA duplex of the invention | 6 |

N/P ratio = Nitrogen:Phosphorous ratio between cationic lipid and nucleic acid.

TABLE 19

| Lipid | Chemical Structure |
|---|---|
| Compound 32 | (structure) |
| Cholesterol | (structure) |
| DSPC | (structure) |

TABLE 19-continued

| Lipid | Chemical Structure |
|---|---|
| PEG-DMG | 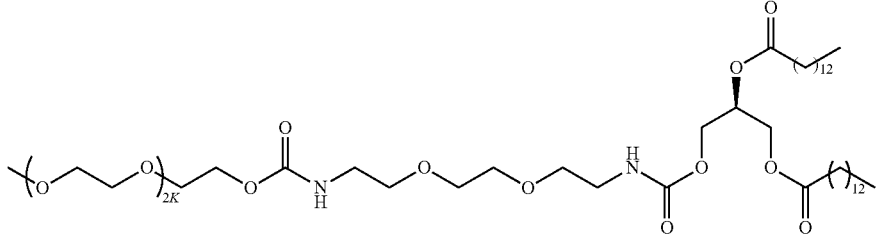 |

Chemical Structures of Lipids in Formulations of Table 18

SEQUENCE LISTING (475 sequences)

SEQ ID NO: 1 - RNA, 19 nt, synthetic construct
  source 1..19: mol_type = other RNA
ctttaacaattcctgaaat

SEQ ID NO: 2 - RNA, 19 nt, synthetic construct
  source 1..19: mol_type = other RNA
acaacagactttaatgtaa

SEQ ID NO: 3 - DNA, 21 bp, synthetic construct
  source 1..21: mol_type = other DNA
  modified_base 1: mod_base = OTHER; note = 2'-deoxy-2'-fluorocytidine-3'-phosphate 5'-phosphate 5'-5' inverted abasic nucleoside ester
  modified_base 2: mod_base = OTHER; note = 2'-deoxy-2'-fluorouridine-3'-phosphate
  modified_base 3: mod_base = OTHER; note = 2'-deoxy-2'-fluorouridine-3'-phosphate
  modified_base 4: mod_base = OTHER; note = 2'-deoxy-2'-fluorouridine-3'-phosphate
  modified_base 7: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-deoxy-2'-fluorocytidine-3'-phosphate
  modified_base 13: mod_base = OTHER; note = 2'-deoxy-2'-fluorocytidine-3'-phosphate
  modified_base 14: mod_base = OTHER; note = 2'-deoxy-2'-fluorouridine-3'-phosphate
  modified_base 19: mod_base = OTHER; note = 2'-deoxy-2'-fluorouridine-3'-phosphate
  modified_base 21: mod_base = OTHER; note = 2'-deoxythymidine-3'-phosphate 3'-3' linked inverted abasic nucleoside ester
  misc_feature 1..4: note = RNA
  misc_feature 7: note = RNA
  misc_feature 10..14: note = RNA
  misc_feature 19: note = RNA
  misc_feature 5..6: note = DNA
  misc_feature 8..9: note = DNA
  misc_feature 15..18: note = DNA
  misc_feature 20..21: note = DNA
ctttaacaattcctgaaattt

SEQ ID NO: 4 - RNA, 21 nt, synthetic construct
  source 1..21: mol_type = other RNA
  modified_base 4: mod_base = OTHER; note = 2'-deoxy-2'-fluorouridine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-deoxy-2'-fluorouridine-3'-phosphate
  modified_base 12: mod_base = OTHER; note = 2'-deoxy-2'-fluorouridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine
atttcaggaattgttaaagtt

SEQ ID NO: 5 - DNA, 21 bp, synthetic construct
  source 1..21: mol_type = other DNA
  modified_base 1: mod_base = OTHER; note = 2'-deoxy-2'-fluorocytidine-3'-phosphate 5'-phosphate 5'-5' inverted abasic nucleoside ester connected to an aminoohexyl phosphate linker
  modified_base 2: mod_base = OTHER; note = 2'-deoxy-2'-fluorouridine-3'-phosphate
  modified_base 3: mod_base = OTHER; note = 2'-deoxy-2'-fluorouridine-3'-phosphate
  modified_base 4: mod_base = OTHER; note = 2'-deoxy-2'-fluorouridine-3'-phosphate
  modified_base 7: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-deoxy-2'-fluorocytidine-3'-phosphate
  modified_base 13: mod_base = OTHER; note = 2'-deoxy-2'-fluorocytidine-3'-phosphate
  modified_base 14: mod_base = OTHER; note = 2'-deoxy-2'-fluorouridine-3'-phosphate
  modified_base 19: mod_base = OTHER; note = 2'-deoxy-2'-fluorouridine-3'-phosphate
  modified_base 21: mod_base = OTHER; note = 2'-deoxythymidine-3'-phosphate 3'-3' linked inverted abasic nucleoside ester
  misc_feature 1..4: note = RNA
  misc_feature 7: note = RNA
  misc_feature 10..14: note = RNA
  misc_feature 19: note = RNA
  misc_feature 5..6: note = DNA
  misc_feature 8..9: note = DNA
  misc_feature 15..18: note = DNA
  misc_feature 20..21: note = DNA
ctttaacaattcctgaaattt

SEQ ID NO: 6 - DNA, 21 bp, synthetic construct
  source 1..21: mol_type = other DNA
  modified_base 1: mod_base = OTHER; note = 2'-deoxyadenosine-3'-phosphate 5'-phosphate 5'-5' inverted abasic nucleoside ester connected to an aminoohexyl phosphate linker
  modified_base 2: mod_base = OTHER; note = 2'-deoxy-2'-fluorocytidine-3'-phosphate
  modified_base 5: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-deoxy-2'-fluorouridine-3'-phosphate
  modified_base 15: mod_base = OTHER; note = 2'-deoxy-2'-fluorouridine-3'-phosphate
  modified_base 17: mod_base = OTHER; note = 2'-deoxy-2'-fluorouridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 2: note = RNA
  misc_feature 5: note = RNA
  misc_feature 9..12: note = RNA
  misc_feature 15: note = RNA
  misc_feature 17: note = RNA
  misc_feature 1: note = DNA
  misc_feature 6..8: note = DNA
  misc_feature 13..14: note = DNA
  misc_feature 16: note = DNA
  misc_feature 18..21: note = DNA
acaacagactttaatgtaatt

SEQ ID NO: 7 - RNA, 21 nt, synthetic construct
  source 1..21: mol_type = other RNA
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-deoxy-2'-fluorouridine-3'-phosphate
  modified_base 13: mod_base = OTHER; note = 2'-deoxy-2'-fluorocytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphorothioate
  modified_base 21: mod_base = OTHER; note = 2'-O-methyluridine
ttacattaaagtctgttgttt

SEQ ID NO: 8 - DNA, 21 bp, synthetic construct
  source 1..21: mol_type = other DNA
  modified_base 1: mod_base = OTHER; note = 2'-deoxy-2'-fluorocytidine-3'-phosphate 5'-phosphate 5'-5' inverted abasic nucleoside ester connected to an aminoohexyl phosphate linker
  modified_base 2: mod_base = OTHER; note = 2'-deoxy-2'-fluorouridine-3'-phosphate
  modified_base 3: mod_base = OTHER; note = 2'-deoxy-2'-fluorouridine-3'-phosphate
  modified_base 4: mod_base = OTHER; note = 2'-deoxy-2'-fluorouridine-3'-phosphate
  modified_base 7: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-deoxy-2'-fluorocytidine-3'-phosphate
  modified_base 13: mod_base = OTHER; note = 2'-deoxy-2'-fluorocytidine-3'-phosphate
  modified_base 14: mod_base = OTHER; note = 2'-deoxy-2'-fluorouridine-3'-phosphate
  modified_base 19: mod_base = OTHER; note = 2'-deoxy-2'-fluorouridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..4: note = RNA
  misc_feature 7: note = RNA
  misc_feature 10..14: note = RNA
  misc_feature 19: note = RNA
  misc_feature 5..6: note = DNA
  misc_feature 8..9: note = DNA
  misc_feature 15..18: note = DNA
  misc_feature 20..21: note = DNA
ctttaacaattcctgaaattt

SEQ ID NO: 9 - RNA, 21 nt, synthetic construct
  source 1..21: mol_type = other RNA
  modified_base 4: mod_base = OTHER; note = 2'-deoxy-2'-fluorouridine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-deoxy-2'-fluorouridine-3'-phosphate
  modified_base 12: mod_base = OTHER; note = 2'-deoxy-2'-fluorouridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphorothioate
  modified_base 21: mod_base = OTHER; note = 2'-O-methyluridine
atttcaggaattgttaaagtt

SEQ ID NO: 10 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = uridine-3'-phosphorothioate
  modified_base 3: mod_base = OTHER; note = uridine-3'-phosphorothioate
  modified_base 4: mod_base = OTHER; note = 2'-deoxy-2'-fluorouridine-3'-phosphate
  modified_base 5: mod_base = OTHER; note = 2'-deoxy-2'-fluorocytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-deoxy-2'-fluorouridine-3'-phosphate
  modified_base 12: mod_base = OTHER; note = 2'-deoxy-2'-fluorouridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluorouridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphorothioate
  modified_base 21: mod_base = OTHER; note = 2'-O-methyluridine
atttcaggaattgttaaagtt

SEQ ID NO: 11 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ctttaacaattcctgaaattt

SEQ ID NO: 12 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = uridine-3'-phosphorothioate
  modified_base 3: mod_base = OTHER; note = uridine-3'-phosphorothioate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
atttcaggaattgttaaagtt

SEQ ID NO: 13 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester connected to an aminoohexyl phosphate linker
  modified_base 2: mod_base = OTHER; note = 2'-O-methyluridine-3'-phosphate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ctttaacaattcctgaaattt

SEQ ID NO: 14 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester connected to an aminoohexyl phosphate linker
  modified_base 2: mod_base = OTHER; note = 2'-O-methylcytidine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
acaacagactttaatgtaatt

SEQ ID NO: 15 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = adenosine-3'-phosphorothioate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
ttacattaaagtctgttgttt

SEQ ID NO: 16 - RNA, 21 nt, synthetic construct
  source 1..21: mol_type = other RNA
  modified_base 1: mod_base = OTHER; note = 2'-deoxy-2'-fluorouridine-3'-phosphate
  modified_base 2: mod_base = OTHER; note = 2'-deoxy-2'-fluorouridine-3'-phosphate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
ttacattaaagtctgttgttt

SEQ ID NO: 17 - DNA, 21 bp, synthetic construct
  source 1..21: mol_type = other DNA
  modified_base 1: mod_base = OTHER; note = 2'-deoxy-2'-fluorouridine-3'-phosphate
  modified_base 2: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
  misc_feature 1..2: note = RNA
  misc_feature 4..21: note = RNA
  misc_feature 3: note = DNA
ttacattaaagtctgttgttt

SEQ ID NO: 18 - DNA, 21 bp, synthetic construct
  source 1..21: mol_type = other DNA
  modified_base 2: mod_base = OTHER; note = 2'-deoxy-2'-fluorouridine-3'-phosphate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
  misc_feature 2..21: note = RNA
  misc_feature 1: note = DNA
atttcaggaattgttaaagtt

SEQ ID NO: 19 - RNA, 21 nt, synthetic construct
  source 1..21: mol_type = other RNA
  modified_base 1: mod_base = OTHER; note = 2'-deoxy-2'-fluoroadenosine-3'-phosphate
  modified_base 2: mod_base = OTHER; note = 2'-deoxy-2'-fluorouridine-3'-phosphate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
atttcaggaattgttaaagtt

SEQ ID NO: 20 - DNA, 21 bp, synthetic construct
  source 1..21: mol_type = other DNA
  modified_base 2: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
  misc_feature 2: note = RNA
  misc_feature 4..21: note = RNA
  misc_feature 1: note = DNA
atttcaggaattgttaaagtt

SEQ ID NO: 21 - DNA, 21 bp, synthetic construct
  source 1..21: mol_type = other DNA
  modified_base 1: mod_base = OTHER; note = 2'-deoxy-2'-fluoroadenosine-3'-phosphate
  modified_base 2: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
  misc_feature 1..2: note = RNA
  misc_feature 4..21: note = RNA
  misc_feature 3: note = DNA
atttcaggaattgttaaagtt

SEQ ID NO: 22 - DNA, 21 bp, synthetic construct
  source 1..21: mol_type = other DNA
  modified_base 2: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
  misc_feature 2: note = RNA
  misc_feature 4..21: note = RNA
  misc_feature 1: note = DNA
ttacattaaagtctgttgttt

SEQ ID NO: 23 - DNA, 21 bp, synthetic construct
  source 1..21: mol_type = other DNA
  modified_base 2: mod_base = OTHER; note = 2'-deoxy-2'-fluorouridine-3'-phosphate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
  misc_feature 2..21: note = RNA
  misc_feature 1: note = DNA
ttacattaaagtctgttgttt

SEQ ID NO: 24 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester connected to an aminoohexyl phosphate linker
  modified_base 2: mod_base = OTHER; note = 2'-O-methyluridine-3'-phosphate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = adenosine-3'-phosphate
  modified_base 6: mod_base = OTHER; note = adenosine-3'-phosphate
  modified_base 7: mod_base = OTHER; note = 2'-O-methylcytidine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = guanosine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ctttaacaattcctgaaattt

SEQ ID NO: 25 - DNA, 21 bp, synthetic construct
  source 1..21: mol_type = other DNA
  modified_base 1: mod_base = OTHER; note = adenosine-3'-phosphorothioate
  modified_base 2: mod_base = OTHER; note = uridine-3'-phosphorothioate
  modified_base 3: mod_base = OTHER; note = uridine-3'-phosphorothioate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = guanosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = guanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = adenosine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = guanosine-3'-phosphate
  modified_base 20: mod_base = OTHER; note = 2'-deoxythymidine-3'-phosphorothioate
  misc_feature 1..19: note = RNA
  misc_feature 20..21: note = DNA
atttcaggaattgttaaagtt

SEQ ID NO: 26 - DNA, 21 bp, synthetic construct
  source 1..21: mol_type = other DNA
  modified_base 1: mod_base = OTHER; note = adenosine-3'-phosphate 5'-phosphate 5'-5' inverted abasic nucleoside ester connected to an aminoohexyl phosphate linker
  modified_base 2: mod_base = OTHER; note = 2'-O-methylcytidine-3'-phosphate
  modified_base 3: mod_base = OTHER; note = adenosine-3'-phosphate
  modified_base 4: mod_base = OTHER; note = adenosine-3'-phosphate
  modified_base 5: mod_base = OTHER; note = 2'-O-methylcytidine-3'-phosphate
  modified_base 6: mod_base = OTHER; note = adenosine-3'-phosphate
  modified_base 7: mod_base = OTHER; note = guanosine-3'-phosphate
  modified_base 8: mod_base = OTHER; note = adenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = adenosine-3'-phosphate
  modified_base 14: mod_base = OTHER; note = adenosine-3'-phosphate
  modified_base 15: mod_base = OTHER; note = 2'-O-methyluridine-3'-phosphate
  modified_base 16: mod_base = OTHER; note = guanosine-3'-phosphate
  modified_base 17: mod_base = OTHER; note = 2'-O-methyluridine-3'-phosphate
  modified_base 18: mod_base = OTHER; note = adenosine-3'-phosphate
  modified_base 19: mod_base = OTHER; note = adenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
acaacagactttaatgtaatt

SEQ ID NO: 27 - DNA, 21 bp, synthetic construct
  source 1..21: mol_type = other DNA
  modified_base 2: mod_base = OTHER; note = 2'-deoxy-2'-fluorouridine-3'-phosphate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = adenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = guanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = guanosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  misc_feature 2..19: note = RNA
  misc_feature 1: note = DNA
  misc_feature 20..21: note = DNA
ttacattaaagtctgttgttt

SEQ ID NO: 28 - DNA, 21 bp, synthetic construct
  source 1..21: mol_type = other DNA
  modified_base 1: mod_base = OTHER; note = 2'-deoxy-2'-fluorouridine-3'-phosphate
  modified_base 2: mod_base = OTHER; note = 2'-deoxy-2'-fluorouridine-3'-phosphate
  modified_base 4: mod_base = OTHER; note = 2'-O-methylcytidine-3'-phosphate
  modified_base 5: mod_base = OTHER; note = adenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = adenosine-3'-phosphate
  modified_base 9: mod_base = OTHER; note = adenosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = guanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = guanosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  misc_feature 1..2: note = RNA
  misc_feature 4..19: note = RNA
  misc_feature 3: note = DNA
  misc_feature 20..21: note = DNA
ttacattaaagtctgttgttt

SEQ ID NO: 29-30 - skipped (2 entries)

SEQ ID NO: 31 - RNA, 19 nt, synthetic construct
  source 1..19: mol_type = other RNA
ctctcacatacaattgaaa

SEQ ID NO: 32 - RNA, 19 nt, synthetic construct
  source 1..19: mol_type = other RNA
cagtcctgaaggaatccat

SEQ ID NO: 33 - RNA, 19 nt, synthetic construct
  source 1..19: mol_type = other RNA
ggtatgactgtcaaagtaa

SEQ ID NO: 34 - RNA, 19 nt, synthetic construct
  source 1..19: mol_type = other RNA
ccagtaaggcttctcttaa

SEQ ID NO: 35 - RNA, 19 nt, synthetic construct
  source 1..19: mol_type = other RNA
ggcatacattcgtcccaaa

SEQ ID NO: 36 - RNA, 19 nt, synthetic construct
  source 1..19: mol_type = other RNA
gcttcctcaactattctaa

SEQ ID NO: 37 - RNA, 19 nt, synthetic construct
  source 1..19: mol_type = other RNA
cagcattctaacagccaat

SEQ ID NO: 38 - RNA, 19 nt, synthetic construct
  source 1..19: mol_type = other RNA
gtataggaatgaatggaga

SEQ ID NO: 39 - RNA, 19 nt, synthetic construct
  source 1..19: mol_type = other RNA
cctcctataatgaagcaaa

SEQ ID NO: 40 - RNA, 19 nt, synthetic construct
  source 1..19: mol_type = other RNA
ctcctataatgaagcaaaa

SEQ ID NO: 41 - RNA, 19 nt, synthetic construct
  source 1..19: mol_type = other RNA
ctctctaactaacaaattt

SEQ ID NO: 42 - RNA, 19 nt, synthetic construct
  source 1..19: mol_type = other RNA
caagcagaaggagtgcagc

SEQ ID NO: 43 - RNA, 19 nt, synthetic construct
  source 1..19: mol_type = other RNA
atgagataatagaatttga

SEQ ID NO: 44 - RNA, 19 nt, synthetic construct
  source 1..19: mol_type = other RNA
cgtcaaagatatcaaggtt

SEQ ID NO: 45 - RNA, 19 nt, synthetic construct
  source 1..19: mol_type = other RNA
gaattacagataatgatgt

SEQ ID NO: 46 - RNA, 19 nt, synthetic construct
  source 1..19: mol_type = other RNA
cattcagcagcttgctgca

SEQ ID NO: 47 - RNA, 19 nt, synthetic construct
  source 1..19: mol_type = other RNA
cacaatgcatttagatcaa

SEQ ID NO: 48 - RNA, 19 nt, synthetic construct
  source 1..19: mol_type = other RNA
ccgtgtcaaatactttgtt

SEQ ID NO: 49 - RNA, 19 nt, synthetic construct
  source 1..19: mol_type = other RNA
catagaagccagtatagga

SEQ ID NO: 50 - RNA, 19 nt, synthetic construct
  source 1..19: mol_type = other RNA
acaaagcaatcatttgatt

SEQ ID NO: 51 - RNA, 19 nt, synthetic construct
  source 1..19: mol_type = other RNA
caagtgtcatcacactgaa

SEQ ID NO: 52 - RNA, 19 nt, synthetic construct
  source 1..19: mol_type = other RNA
gtcatcacactgaatacca

SEQ ID NO: 53 - RNA, 19 nt, synthetic construct
  source 1..19: mol_type = other RNA
tcatcacactgaataccaa

SEQ ID NO: 54 - RNA, 19 nt, synthetic construct
  source 1..19: mol_type = other RNA
cagtacaaattagagggaa

SEQ ID NO: 55 - RNA, 19 nt, synthetic construct
  source 1..19: mol_type = other RNA
gaacttaatggaaatacca

SEQ ID NO: 56 - RNA, 19 nt, synthetic construct
  source 1..19: mol_type = other RNA
ttgatcacaagttcagctt

SEQ ID NO: 57 - RNA, 19 nt, synthetic construct
  source 1..19: mol_type = other RNA
gagaaatcaagattaatca

SEQ ID NO: 58 - RNA, 19 nt, synthetic construct
  source 1..19: mol_type = other RNA
ctttgtagactactataaa

SEQ ID NO: 59 - RNA, 19 nt, synthetic construct
  source 1..19: mol_type = other RNA
cgttgataacccaaatgga

SEQ ID NO: 60 - RNA, 19 nt, synthetic construct
  source 1..19: mol_type = other RNA
gaagatgcgtgacatgtat

SEQ ID NO: 61 - RNA, 19 nt, synthetic construct
  source 1..19: mol_type = other RNA
agtggaggtattcttcgaa

SEQ ID NO: 62 - RNA, 19 nt, synthetic construct
  source 1..19: mol_type = other RNA
cattgaacccaaatttgat

SEQ ID NO: 63 - RNA, 19 nt, synthetic construct
  source 1..19: mol_type = other RNA
gcaataactgtttggtatt

SEQ ID NO: 64 - RNA, 19 nt, synthetic construct
  source 1..19: mol_type = other RNA
cagtcagcaaagacgtcta

SEQ ID NO: 65 - RNA, 19 nt, synthetic construct
  source 1..19: mol_type = other RNA
gcagtacccacgtcaccta

SEQ ID NO: 66 - RNA, 19 nt, synthetic construct
  source 1..19: mol_type = other RNA
gagacacctgcctggtatt

SEQ ID NO: 67 - RNA, 19 nt, synthetic construct
  source 1..19: mol_type = other RNA
gaaacaagggccctttgta

SEQ ID NO: 68 - RNA, 19 nt, synthetic construct
  source 1..19: mol_type = other RNA
caaggagcccggctgcgaa

SEQ ID NO: 69 - RNA, 19 nt, synthetic construct
  source 1..19: mol_type = other RNA
cgggaagctgggcagctac

SEQ ID NO: 70 - RNA, 19 nt, synthetic construct
  source 1..19: mol_type = other RNA
ggacgaaagccatggttgc

SEQ ID NO: 71 - RNA, 19 nt, synthetic construct
  source 1..19: mol_type = other RNA
aagccatggttgcttgtta

SEQ ID NO: 72 - RNA, 19 nt, synthetic construct
  source 1..19: mol_type = other RNA
gatggaagatgtgtgacat

SEQ ID NO: 73 - RNA, 19 nt, synthetic construct
  source 1..19: mol_type = other RNA
gatgtgtgacatgtatata

SEQ ID NO: 74 - RNA, 19 nt, synthetic construct
  source 1..19: mol_type = other RNA
gactgggatgccaaggtaa

SEQ ID NO: 75 - RNA, 19 nt, synthetic construct
  source 1..19: mol_type = other RNA
gcccagtttgctgacattg

SEQ ID NO: 76 - RNA, 19 nt, synthetic construct
  source 1..19: mol_type = other RNA
ttgctgacattgaacccaa

SEQ ID NO: 77 - RNA, 19 nt, synthetic construct
  source 1..19: mol_type = other RNA
tcgcaaccctcatgaagta

SEQ ID NO: 78 - RNA, 19 nt, synthetic construct
  source 1..19: mol_type = other RNA
ctcatgaagtacaaccagc

SEQ ID NO: 79 - RNA, 19 nt, synthetic construct
  source 1..19: mol_type = other RNA
gtgtgagggttgaactcaa

SEQ ID NO: 80 - RNA, 19 nt, synthetic construct
  source 1..19: mol_type = other RNA
atgctacaaggtacgcaat

SEQ ID NO: 81 - RNA, 19 nt, synthetic construct
  source 1..19: mol_type = other RNA
aaggtacgcaataactgtt

SEQ ID NO: 82 - RNA, 19 nt, synthetic construct
  source 1..19: mol_type = other RNA
ggtgtgagggttgaactca

SEQ ID NO: 83 - RNA, 19 nt, synthetic construct
  source 1..19: mol_type = other RNA
tgaaggctgggtacctttg

SEQ ID NO: 84 - RNA, 19 nt, synthetic construct
  source 1..19: mol_type = other RNA
atctgtcatcaaattgagt

SEQ ID NO: 85 - RNA, 19 nt, synthetic construct
  source 1..19: mol_type = other RNA
tctgtcatcaaattgagta

SEQ ID NO: 86 - RNA, 19 nt, synthetic construct
  source 1..19: mol_type = other RNA
ctgtcatcaaattgagtat

SEQ ID NO: 87 - RNA, 19 nt, synthetic construct
  source 1..19: mol_type = other RNA
gtcatcaaattgagtatta

SEQ ID NO: 88 - RNA, 19 nt, synthetic construct
  source 1..19: mol_type = other RNA
tcatcaaattgagtattat

SEQ ID NO: 89 - RNA, 19 nt, synthetic construct
  source 1..19: mol_type = other RNA
tggagacttcaatttgcca

SEQ ID NO: 90 - RNA, 19 nt, synthetic construct
  source 1..19: mol_type = other RNA
tggatgaaggctgggtacc

SEQ ID NO: 91 - RNA, 19 nt, synthetic construct
  source 1..19: mol_type = other RNA
ggatgaaggctgggtacct

SEQ ID NO: 92 - RNA, 19 nt, synthetic construct
  source 1..19: mol_type = other RNA
gatgaaggctgggtacctt

SEQ ID NO: 93 - RNA, 19 nt, synthetic construct
  source 1..19: mol_type = other RNA
atgaaggctgggtaccttt

SEQ ID NO: 94 - RNA, 19 nt, synthetic construct
  source 1..19: mol_type = other RNA
aaggctgggtacctttgga

SEQ ID NO: 95 - RNA, 19 nt, synthetic construct
  source 1..19: mol_type = other RNA
ggctgggtacctttggaaa

SEQ ID NO: 96 - RNA, 19 nt, synthetic construct
  source 1..19: mol_type = other RNA
ctgggtacctttggaaaca

SEQ ID NO: 97 - RNA, 19 nt, synthetic construct
  source 1..19: mol_type = other RNA
gcagaccactccctgaagt

SEQ ID NO: 98 - RNA, 19 nt, synthetic construct
  source 1..19: mol_type = other RNA
cctgaagtgacggatgagt

SEQ ID NO: 99 - RNA, 19 nt, synthetic construct
  source 1..19: mol_type = other RNA
aaatcatggtgaaataaaa

SEQ ID NO: 100 - RNA, 19 nt, synthetic construct
  source 1..19: mol_type = other RNA
tgcaaataatggtaaccta

SEQ ID NO: 101 - RNA, 19 nt, synthetic construct
  source 1..19: mol_type = other RNA
gcaaataatggtaacctac

SEQ ID NO: 102 - RNA, 19 nt, synthetic construct
  source 1..19: mol_type = other RNA
ataatggtaacctactgtt

SEQ ID NO: 103 - RNA, 19 nt, synthetic construct
  source 1..19: mol_type = other RNA
ggtaacctactgttaagga

SEQ ID NO: 104 - RNA, 19 nt, synthetic construct
  source 1..19: mol_type = other RNA
aagtactagaaggacatgc

SEQ ID NO: 105 - RNA, 19 nt, synthetic construct
  source 1..19: mol_type = other RNA
aaggaagaggacagtttca

SEQ ID NO: 106 - RNA, 19 nt, synthetic construct
  source 1..19: mol_type = other RNA
ggaggacaagatttgatga

SEQ ID NO: 107 - RNA, 19 nt, synthetic construct
  source 1..19: mol_type = other RNA
cagagaagaacccgcatca

SEQ ID NO: 108 - RNA, 19 nt, synthetic construct
  source 1..19: mol_type = other RNA
gagaagaacccgcatcaaa

SEQ ID NO: 109 - RNA, 19 nt, synthetic construct
  source 1..19: mol_type = other RNA
ctacacaaatcagcgattt

SEQ ID NO: 110 - RNA, 19 nt, synthetic construct
  source 1..19: mol_type = other RNA
ggacttctctcaattttct

SEQ ID NO: 111 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ctctcacatacaattgaaatt

SEQ ID NO: 112 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tttcaattgtatgtgagagtt

SEQ ID NO: 113 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
cagtcctgaaggaatccattt

SEQ ID NO: 114 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
atggattccttcaggactgtt

SEQ ID NO: 115 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ggtatgactgtcaaagtaatt

SEQ ID NO: 116 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttactttgacagtcatacctt

SEQ ID NO: 117 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ccagtaaggcttctcttaatt

SEQ ID NO: 118 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttaagagaagccttactggtt

SEQ ID NO: 119 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ggcatacattcgtcccaaatt

SEQ ID NO: 120 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tttgggacgaatgtatgcctt

SEQ ID NO: 121 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gcttcctcaactattctaatt

SEQ ID NO: 122 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttagaatagttgaggaagctt

SEQ ID NO: 123 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
cagcattctaacagccaattt

SEQ ID NO: 124 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
attggctgttagaatgctgtt

SEQ ID NO: 125 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gtataggaatgaatggagatt

SEQ ID NO: 126 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tctccattcattcctatactt

SEQ ID NO: 127 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
cctcctataatgaagcaaatt

SEQ ID NO: 128 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tttgcttcattataggaggtt

SEQ ID NO: 129 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ctcctataatgaagcaaaatt

SEQ ID NO: 130 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttttgcttcattataggagtt

SEQ ID NO: 131 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ctctctaactaacaaattttt

SEQ ID NO: 132 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
aaatttgttagttagagagtt

SEQ ID NO: 133 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
caagcagaaggagtgcagctt

SEQ ID NO: 134 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
gctgcactccttctgcttgtt

SEQ ID NO: 135 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
atgagataatagaatttgatt

SEQ ID NO: 136 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tcaaattctattatctcattt

SEQ ID NO: 137 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
cgtcaaagatatcaaggtttt

SEQ ID NO: 138 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
aaccttgatatctttgacgtt

SEQ ID NO: 139 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gaattacagataatgatgttt

SEQ ID NO: 140 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
acatcattatctgtaattctt

SEQ ID NO: 141 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
cattcagcagcttgctgcatt

SEQ ID NO: 142 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tgcagcaagctgctgaatgtt

SEQ ID NO: 143 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
cacaatgcatttagatcaatt

SEQ ID NO: 144 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttgatctaaatgcattgtgtt

SEQ ID NO: 145 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ccgtgtcaaatactttgtttt

SEQ ID NO: 146 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
aacaaagtatttgacacggtt

SEQ ID NO: 147 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
catagaagccagtataggatt

SEQ ID NO: 148 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tcctatactggcttctatgtt

SEQ ID NO: 149 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ctttaacaattcctgaaattt

SEQ ID NO: 150 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
atttcaggaattgttaaagtt

SEQ ID NO: 151 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
acaaagcaatcatttgatttt

SEQ ID NO: 152 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
aatcaaatgattgctttgttt

SEQ ID NO: 153 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
caagtgtcatcacactgaatt

SEQ ID NO: 154 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttcagtgtgatgacacttgtt

SEQ ID NO: 155 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gtcatcacactgaataccatt

SEQ ID NO: 156 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tggtattcagtgtgatgactt

SEQ ID NO: 157 - RNA, 21 nt, synthetic construct
  source 1..21: mol_type = other RNA
  modified_base 1: mod_base = OTHER; note = uridine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
tcatcacactgaataccaatt

SEQ ID NO: 158 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttggtattcagtgtgatgatt

SEQ ID NO: 159 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
cagtacaaattagagggaatt

SEQ ID NO: 160 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttccctctaatttgtactgtt

SEQ ID NO: 161 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gaacttaatggaaataccatt

SEQ ID NO: 162 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tggtatttccattaagttctt

SEQ ID NO: 163 - RNA, 21 nt, synthetic construct
  source 1..21: mol_type = other RNA
  modified_base 1: mod_base = OTHER; note = uridine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ttgatcacaagttcagctttt

SEQ ID NO: 164 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
aagctgaacttgtgatcaatt

SEQ ID NO: 165 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gagaaatcaagattaatcatt

SEQ ID NO: 166 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tgattaatcttgatttctctt

SEQ ID NO: 167 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ctttgtagactactataaatt

SEQ ID NO: 168 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tttatagtagtctacaaagtt

SEQ ID NO: 169 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ctctcacatacaattgaaatt

SEQ ID NO: 170 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = uridine-3'-phosphorothioate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
tttcaattgtatgtgagagtt

SEQ ID NO: 171 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
cagtcctgaaggaatccattt

SEQ ID NO: 172 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = uridine-3'-phosphorothioate
  modified_base 3: mod_base = OTHER; note = guanosine-3'-phosphorothioate
  modified_base 4: mod_base = OTHER; note = 2'-deoxy-2'-fluoroguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
atggattccttcaggactgtt

SEQ ID NO: 173 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ggtatgactgtcaaagtaatt

SEQ ID NO: 174 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = adenosine-3'-phosphorothioate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
ttactttgacagtcatacctt

SEQ ID NO: 175 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ccagtaaggcttctcttaatt

SEQ ID NO: 176 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = adenosine-3'-phosphorothioate
  modified_base 4: mod_base = OTHER; note = 2'-deoxy-2'-fluoroadenosine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
ttaagagaagccttactggtt

SEQ ID NO: 177 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-deoxy-2'-fluoroguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ggcatacattcgtcccaaatt

SEQ ID NO: 178 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = uridine-3'-phosphorothioate
  modified_base 4: mod_base = OTHER; note = 2'-deoxy-2'-fluoroguanosine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
tttgggacgaatgtatgcctt

SEQ ID NO: 179 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gcttcctcaactattctaatt

SEQ ID NO: 180 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = adenosine-3'-phosphorothioate
  modified_base 4: mod_base = OTHER; note = 2'-deoxy-2'-fluoroguanosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
ttagaatagttgaggaagctt

SEQ ID NO: 181 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
cagcattctaacagccaattt

SEQ ID NO: 182 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = uridine-3'-phosphorothioate
  modified_base 3: mod_base = OTHER; note = uridine-3'-phosphorothioate
  modified_base 4: mod_base = OTHER; note = 2'-deoxy-2'-fluoroguanosine-3'-phosphate
  modified_base 5: mod_base = OTHER; note = 2'-deoxy-2'-fluoroguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
attggctgttagaatgctgtt

SEQ ID NO: 183 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroguanosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gtataggaatgaatggagatt

SEQ ID NO: 184 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = cytidine-3'-phosphorothioate
  modified_base 3: mod_base = OTHER; note = uridine-3'-phosphorothioate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
tctccattcattcctatactt

SEQ ID NO: 185 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
cctcctataatgaagcaaatt

SEQ ID NO: 186 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = uridine-3'-phosphorothioate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroguanosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
tttgcttcattataggaggtt

SEQ ID NO: 187 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ctcctataatgaagcaaaatt

SEQ ID NO: 188 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = uridine-3'-phosphorothioate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroguanosine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
ttttgcttcattataggagtt

SEQ ID NO: 189 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroadenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ctctctaactaacaaattttt

SEQ ID NO: 190 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = adenosine-3'-phosphorothioate
  modified_base 3: mod_base = OTHER; note = adenosine-3'-phosphorothioate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
aaatttgttagttagagagtt

SEQ ID NO: 191 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
caagcagaaggagtgcagctt

SEQ ID NO: 192 - RNA, 21 nt, synthetic construct
  source 1..21: mol_type = other RNA
  modified_base 1: mod_base = OTHER; note = guanosine-3'-phosphorothioate
  modified_base 2: mod_base = OTHER; note = cytidine-3'-phosphorothioate
  modified_base 3: mod_base = OTHER; note = uridine-3'-phosphorothioate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
gctgcactccttctgcttgtt

SEQ ID NO: 193 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroadenosine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
atgagataatagaatttgatt

SEQ ID NO: 194 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = cytidine-3'-phosphorothioate
  modified_base 3: mod_base = OTHER; note = adenosine-3'-phosphorothioate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
tcaaattctattatctcattt

SEQ ID NO: 195 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroguanosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
cgtcaaagatatcaaggtttt

SEQ ID NO: 196 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = adenosine-3'-phosphorothioate
  modified_base 3: mod_base = OTHER; note = cytidine-3'-phosphorothioate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
aaccttgatatctttgacgtt

SEQ ID NO: 197 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gaattacagataatgatgttt

SEQ ID NO: 198 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = cytidine-3'-phosphorothioate
  modified_base 3: mod_base = OTHER; note = adenosine-3'-phosphorothioate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
acatcattatctgtaattctt

SEQ ID NO: 199 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
cattcagcagcttgctgcatt

SEQ ID NO: 200 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = guanosine-3'-phosphorothioate
  modified_base 3: mod_base = OTHER; note = cytidine-3'-phosphorothioate
  modified_base 4: mod_base = OTHER; note = 2'-deoxy-2'-fluoroadenosine-3'-phosphate
  modified_base 5: mod_base = OTHER; note = 2'-deoxy-2'-fluoroguanosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
tgcagcaagctgctgaatgtt

SEQ ID NO: 201 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
cacaatgcatttagatcaatt

SEQ ID NO: 202 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = guanosine-3'-phosphorothioate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
ttgatctaaatgcattgtgtt

SEQ ID NO: 203 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-deoxy-2'-fluoroadenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ccgtgtcaaatactttgtttt

SEQ ID NO: 204 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = adenosine-3'-phosphorothioate
  modified_base 3: mod_base = OTHER; note = cytidine-3'-phosphorothioate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
aacaaagtatttgacacggtt

SEQ ID NO: 205 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
catagaagccagtataggatt

SEQ ID NO: 206 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = cytidine-3'-phosphorothioate
  modified_base 3: mod_base = OTHER; note = cytidine-3'-phosphorothioate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
tcctatactggcttctatgtt

SEQ ID NO: 207 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
acaaagcaatcatttgatttt

SEQ ID NO: 208 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = adenosine-3'-phosphorothioate
  modified_base 3: mod_base = OTHER; note = uridine-3'-phosphorothioate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
aatcaaatgattgctttgttt

SEQ ID NO: 209 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-deoxy-2'-fluoroadenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
caagtgtcatcacactgaatt

SEQ ID NO: 210 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = cytidine-3'-phosphorothioate
  modified_base 4: mod_base = OTHER; note = 2'-deoxy-2'-fluoroadenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluorocytidine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
ttcagtgtgatgacacttgtt

SEQ ID NO: 211 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gtcatcacactgaataccatt

SEQ ID NO: 212 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = guanosine-3'-phosphorothioate
  modified_base 3: mod_base = OTHER; note = guanosine-3'-phosphorothioate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
tggtattcagtgtgatgactt

SEQ ID NO: 213 - DNA, 21 bp, synthetic construct
  source 1..21: mol_type = other DNA
  modified_base 1: mod_base = OTHER; note = 2'-O-methyluridine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
tcatcacactgaataccaatt

SEQ ID NO: 214 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = guanosine-3'-phosphorothioate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphorothioate
  modified_base 21: mod_base = OTHER; note = 2'-O-methyluridine
ttggtattcagtgtgatgatt

SEQ ID NO: 215 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroguanosine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
cagtacaaattagagggaatt

SEQ ID NO: 216 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = cytidine-3'-phosphorothioate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
ttccctctaatttgtactgtt

SEQ ID NO: 217 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gaacttaatggaaataccatt

SEQ ID NO: 218 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = guanosine-3'-phosphorothioate
  modified_base 3: mod_base = OTHER; note = guanosine-3'-phosphorothioate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
tggtatttccattaagttctt

SEQ ID NO: 219 - DNA, 21 bp, synthetic construct
  source 1..21: mol_type = other DNA
  modified_base 1: mod_base = OTHER; note = 2'-O-methyluridine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ttgatcacaagttcagctttt

SEQ ID NO: 220 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = adenosine-3'-phosphorothioate
  modified_base 3: mod_base = OTHER; note = guanosine-3'-phosphorothioate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphorothioate
  modified_base 21: mod_base = OTHER; note = 2'-O-methyluridine
aagctgaacttgtgatcaatt

SEQ ID NO: 221 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gagaaatcaagattaatcatt

SEQ ID NO: 222 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = guanosine-3'-phosphorothioate
  modified_base 3: mod_base = OTHER; note = adenosine-3'-phosphorothioate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
tgattaatcttgatttctctt

SEQ ID NO: 223 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-deoxy-2'-fluoroadenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ctttgtagactactataaatt

SEQ ID NO: 224 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = uridine-3'-phosphorothioate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
tttatagtagtctacaaagtt

SEQ ID NO: 225 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
cgttgataacccaaatggatt

SEQ ID NO: 226 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tccatttgggttatcaacgtt

SEQ ID NO: 227 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gaagatgcgtgacatgtattt

SEQ ID NO: 228 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
atacatgtcacgcatcttctt

SEQ ID NO: 229 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
agtggaggtattcttcgaatt

SEQ ID NO: 230 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttcgaagaatacctccacttt

SEQ ID NO: 231 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
cattgaacccaaatttgattt

SEQ ID NO: 232 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
atcaaatttgggttcaatgtt

SEQ ID NO: 233 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gcaataactgtttggtatttt

SEQ ID NO: 234 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
aataccaaacagttattgctt

SEQ ID NO: 235 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
cagtcagcaaagacgtctatt

SEQ ID NO: 236 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tagacgtctttgctgactgtt

SEQ ID NO: 237 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gcagtacccacgtcacctatt

SEQ ID NO: 238 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
taggtgacgtgggtactgctt

SEQ ID NO: 239 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gagacacctgcctggtatttt

SEQ ID NO: 240 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
aataccaggcaggtgtctctt

SEQ ID NO: 241 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gaaacaagggccctttgtatt

SEQ ID NO: 242 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tacaaagggcccttgtttctt

SEQ ID NO: 243 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
caaggagcccggctgcgaatt

SEQ ID NO: 244 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttcgcagccgggctccttgtt

SEQ ID NO: 245 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
cgggaagctgggcagctactt

SEQ ID NO: 246 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
gtagctgcccagcttcccgtt

SEQ ID NO: 247 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ggacgaaagccatggttgctt

SEQ ID NO: 248 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
gcaaccatggctttcgtcctt

SEQ ID NO: 249 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
aagccatggttgcttgttatt

SEQ ID NO: 250 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
taacaagcaaccatggctttt

SEQ ID NO: 251 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gatggaagatgtgtgacattt

SEQ ID NO: 252 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
atgtcacacatcttccatctt

SEQ ID NO: 253 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gatgtgtgacatgtatatatt

SEQ ID NO: 254 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tatatacatgtcacacatctt

SEQ ID NO: 255 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gactgggatgccaaggtaatt

SEQ ID NO: 256 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttaccttggcatcccagtctt

SEQ ID NO: 257 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gcccagtttgctgacattgtt

SEQ ID NO: 258 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
caatgtcagcaaactgggctt

SEQ ID NO: 259 - RNA, 21 nt, synthetic construct
  source 1..21: mol_type = other RNA
  modified_base 1: mod_base = OTHER; note = uridine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ttgctgacattgaacccaatt

SEQ ID NO: 260 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttgggttcaatgtcagcaatt

SEQ ID NO: 261 - RNA, 21 nt, synthetic construct
  source 1..21: mol_type = other RNA
  modified_base 1: mod_base = OTHER; note = uridine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
tcgcaaccctcatgaagtatt

SEQ ID NO: 262 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tacttcatgagggttgcgatt

SEQ ID NO: 263 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ctcatgaagtacaaccagctt

SEQ ID NO: 264 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
gctggttgtacttcatgagtt

SEQ ID NO: 265 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gtgtgagggttgaactcaatt

SEQ ID NO: 266 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttgagttcaaccctcacactt

SEQ ID NO: 267 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
atgctacaaggtacgcaattt

SEQ ID NO: 268 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
attgcgtaccttgtagcattt

SEQ ID NO: 269 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
aaggtacgcaataactgtttt

SEQ ID NO: 270 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
aacagttattgcgtacctttt

SEQ ID NO: 271 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ggtgtgagggttgaactcatt

SEQ ID NO: 272 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tgagttcaaccctcacacctt

SEQ ID NO: 273 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
cgttgataacccaaatggatt

SEQ ID NO: 274 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = cytidine-3'-phosphorothioate
  modified_base 3: mod_base = OTHER; note = cytidine-3'-phosphorothioate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
tccatttgggttatcaacgtt

SEQ ID NO: 275 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroadenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gaagatgcgtgacatgtattt

SEQ ID NO: 276 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = uridine-3'-phosphorothioate
  modified_base 3: mod_base = OTHER; note = adenosine-3'-phosphorothioate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-deoxy-2'-fluoroguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
atacatgtcacgcatcttctt

SEQ ID NO: 277 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
agtggaggtattcttcgaatt

SEQ ID NO: 278 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = cytidine-3'-phosphorothioate
  modified_base 4: mod_base = OTHER; note = 2'-deoxy-2'-fluoroguanosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
ttcgaagaatacctccacttt

SEQ ID NO: 279 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
cattgaacccaaatttgattt

SEQ ID NO: 280 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = uridine-3'-phosphorothioate
  modified_base 3: mod_base = OTHER; note = cytidine-3'-phosphorothioate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
atcaaatttgggttcaatgtt

SEQ ID NO: 281 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gcaataactgtttggtatttt

SEQ ID NO: 282 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = adenosine-3'-phosphorothioate
  modified_base 3: mod_base = OTHER; note = uridine-3'-phosphorothioate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
aataccaaacagttattgctt

SEQ ID NO: 283 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroadenosine-3'-phosphate
  modified_base 14: mod_base = OTHER; note = 2'-O-methylcytidine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
cagtcagcaaagacgtctatt

SEQ ID NO: 284 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = adenosine-3'-phosphorothioate
  modified_base 3: mod_base = OTHER; note = guanosine-3'-phosphorothioate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
tagacgtctttgctgactgtt

SEQ ID NO: 285 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-deoxy-2'-fluoroguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gcagtacccacgtcacctatt

SEQ ID NO: 286 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = adenosine-3'-phosphorothioate
  modified_base 3: mod_base = OTHER; note = guanosine-3'-phosphorothioate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
taggtgacgtgggtactgctt

SEQ ID NO: 287 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gagacacctgcctggtatttt

SEQ ID NO: 288 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = adenosine-3'-phosphorothioate
  modified_base 3: mod_base = OTHER; note = uridine-3'-phosphorothioate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
aataccaggcaggtgtctctt

SEQ ID NO: 289 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gaaacaagggccctttgtatt

SEQ ID NO: 290 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = adenosine-3'-phosphorothioate
  modified_base 3: mod_base = OTHER; note = cytidine-3'-phosphorothioate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
tacaaagggcccttgtttctt

SEQ ID NO: 291 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroguanosine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
caaggagcccggctgcgaatt

SEQ ID NO: 292 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = cytidine-3'-phosphorothioate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
ttcgcagccgggctccttgtt

SEQ ID NO: 293 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroguanosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
cgggaagctgggcagctactt

SEQ ID NO: 294 - RNA, 21 nt, synthetic construct
  source 1..21: mol_type = other RNA
  modified_base 1: mod_base = OTHER; note = guanosine-3'-phosphorothioate
  modified_base 2: mod_base = OTHER; note = uridine-3'-phosphorothioate
  modified_base 3: mod_base = OTHER; note = adenosine-3'-phosphorothioate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
gtagctgcccagcttcccgtt

SEQ ID NO: 295 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-deoxy-2'-fluoroadenosine-3'-phosphate
  modified_base 4: mod_base = OTHER; note = 2'-O-methylcytidine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ggacgaaagccatggttgctt

SEQ ID NO: 296 - RNA, 21 nt, synthetic construct
  source 1..21: mol_type = other RNA
  modified_base 1: mod_base = OTHER; note = guanosine-3'-phosphorothioate
  modified_base 2: mod_base = OTHER; note = cytidine-3'-phosphorothioate
  modified_base 3: mod_base = OTHER; note = adenosine-3'-phosphorothioate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
gcaaccatggctttcgtcctt

SEQ ID NO: 297 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
aagccatggttgcttgttatt

SEQ ID NO: 298 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = adenosine-3'-phosphorothioate
  modified_base 3: mod_base = OTHER; note = adenosine-3'-phosphorothioate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
taacaagcaaccatggctttt

SEQ ID NO: 299 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gatggaagatgtgtgacattt

SEQ ID NO: 300 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = uridine-3'-phosphorothioate
  modified_base 3: mod_base = OTHER; note = guanosine-3'-phosphorothioate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
atgtcacacatcttccatctt

SEQ ID NO: 301 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gatgtgtgacatgtatatatt

SEQ ID NO: 302 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = adenosine-3'-phosphorothioate
  modified_base 3: mod_base = OTHER; note = uridine-3'-phosphorothioate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluorocytidine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
tatatacatgtcacacatctt

SEQ ID NO: 303 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gactgggatgccaaggtaatt

SEQ ID NO: 304 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = adenosine-3'-phosphorothioate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
ttaccttggcatcccagtctt

SEQ ID NO: 305 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gcccagtttgctgacattgtt

SEQ ID NO: 306 - RNA, 21 nt, synthetic construct
  source 1..21: mol_type = other RNA
  modified_base 1: mod_base = OTHER; note = cytidine-3'-phosphorothioate
  modified_base 2: mod_base = OTHER; note = adenosine-3'-phosphorothioate
  modified_base 3: mod_base = OTHER; note = adenosine-3'-phosphorothioate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
caatgtcagcaaactgggctt

SEQ ID NO: 307 - DNA, 21 bp, synthetic construct
  source 1..21: mol_type = other DNA
  modified_base 1: mod_base = OTHER; note = 2'-O-methyluridine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ttgctgacattgaacccaatt

SEQ ID NO: 308 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = guanosine-3'-phosphorothioate
  modified_base 4: mod_base = OTHER; note = 2'-deoxy-2'-fluoroguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphorothioate
  modified_base 21: mod_base = OTHER; note = 2'-O-methyluridine
ttgggttcaatgtcagcaatt

SEQ ID NO: 309 - DNA, 21 bp, synthetic construct
  source 1..21: mol_type = other DNA
  modified_base 1: mod_base = OTHER; note = 2'-O-methyluridine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
tcgcaaccctcatgaagtatt

SEQ ID NO: 310 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = adenosine-3'-phosphorothioate
  modified_base 3: mod_base = OTHER; note = cytidine-3'-phosphorothioate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphorothioate
  modified_base 21: mod_base = OTHER; note = 2'-O-methyluridine
tacttcatgagggttgcgatt

SEQ ID NO: 311 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ctcatgaagtacaaccagctt

SEQ ID NO: 312 - RNA, 21 nt, synthetic construct
  source 1..21: mol_type = other RNA
  modified_base 1: mod_base = OTHER; note = guanosine-3'-phosphorothioate
  modified_base 2: mod_base = OTHER; note = cytidine-3'-phosphorothioate
  modified_base 3: mod_base = OTHER; note = uridine-3'-phosphorothioate
  modified_base 4: mod_base = OTHER; note = 2'-deoxy-2'-fluoroguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
gctggttgtacttcatgagtt

SEQ ID NO: 313 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gtgtgagggttgaactcaatt

SEQ ID NO: 314 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = guanosine-3'-phosphorothioate
  modified_base 4: mod_base = OTHER; note = 2'-deoxy-2'-fluoroadenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
ttgagttcaaccctcacactt

SEQ ID NO: 315 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-deoxy-2'-fluoroguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methylcytidine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
atgctacaaggtacgcaattt

SEQ ID NO: 316 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = uridine-3'-phosphorothioate
  modified_base 3: mod_base = OTHER; note = uridine-3'-phosphorothioate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
attgcgtaccttgtagcattt

SEQ ID NO: 317 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
aaggtacgcaataactgtttt

SEQ ID NO: 318 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = adenosine-3'-phosphorothioate
  modified_base 3: mod_base = OTHER; note = cytidine-3'-phosphorothioate
  modified_base 4: mod_base = OTHER; note = 2'-deoxy-2'-fluoroadenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
aacagttattgcgtacctttt

SEQ ID NO: 319 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ggtgtgagggttgaactcatt

SEQ ID NO: 320 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = guanosine-3'-phosphorothioate
  modified_base 3: mod_base = OTHER; note = adenosine-3'-phosphorothioate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
tgagttcaaccctcacacctt

SEQ ID NO: 321 - RNA, 21 nt, synthetic construct
  source 1..21: mol_type = other RNA
  modified_base 1: mod_base = OTHER; note = uridine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
tgaaggctgggtacctttgtt

SEQ ID NO: 322 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
caaaggtacccagccttcatt

SEQ ID NO: 323 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
atctgtcatcaaattgagttt

SEQ ID NO: 324 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
actcaatttgatgacagattt

SEQ ID NO: 325 - RNA, 21 nt, synthetic construct
  source 1..21: mol_type = other RNA
  modified_base 1: mod_base = OTHER; note = uridine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
tctgtcatcaaattgagtatt

SEQ ID NO: 326 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tactcaatttgatgacagatt

SEQ ID NO: 327 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ctgtcatcaaattgagtattt

SEQ ID NO: 328 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
atactcaatttgatgacagtt

SEQ ID NO: 329 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gtcatcaaattgagtattatt

SEQ ID NO: 330 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
taatactcaatttgatgactt

SEQ ID NO: 331 - RNA, 21 nt, synthetic construct
  source 1..21: mol_type = other RNA
  modified_base 1: mod_base = OTHER; note = uridine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
tcatcaaattgagtattattt

SEQ ID NO: 332 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ataatactcaatttgatgatt

SEQ ID NO: 333 - RNA, 21 nt, synthetic construct
  source 1..21: mol_type = other RNA
  modified_base 1: mod_base = OTHER; note = uridine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
tggagacttcaatttgccatt

SEQ ID NO: 334 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tggcaaattgaagtctccatt

SEQ ID NO: 335 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
acaacagactttaatgtaatt

SEQ ID NO: 336 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttacattaaagtctgttgttt

SEQ ID NO: 337 - RNA, 21 nt, synthetic construct
  source 1..21: mol_type = other RNA
  modified_base 1: mod_base = OTHER; note = uridine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
tggatgaaggctgggtacctt

SEQ ID NO: 338 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ggtacccagccttcatccatt

SEQ ID NO: 339 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ggatgaaggctgggtaccttt

SEQ ID NO: 340 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
aggtacccagccttcatcctt

SEQ ID NO: 341 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gatgaaggctgggtacctttt

SEQ ID NO: 342 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
aaggtacccagccttcatctt

SEQ ID NO: 343 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
atgaaggctgggtaccttttt

SEQ ID NO: 344 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
aaaggtacccagccttcattt

SEQ ID NO: 345 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
aaggctgggtacctttggatt

SEQ ID NO: 346 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tccaaaggtacccagcctttt

SEQ ID NO: 347 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ggctgggtacctttggaaatt

SEQ ID NO: 348 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tttccaaaggtacccagcctt

SEQ ID NO: 349 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ctgggtacctttggaaacatt

SEQ ID NO: 350 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tgtttccaaaggtacccagtt

SEQ ID NO: 351 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gcagaccactccctgaagttt

SEQ ID NO: 352 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
acttcagggagtggtctgctt

SEQ ID NO: 353 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
cctgaagtgacggatgagttt

SEQ ID NO: 354 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
actcatccgtcacttcaggtt

SEQ ID NO: 355 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
aaatcatggtgaaataaaatt

SEQ ID NO: 356 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
ttttatttcaccatgattttt

SEQ ID NO: 357 - RNA, 21 nt, synthetic construct
  source 1..21: mol_type = other RNA
  modified_base 1: mod_base = OTHER; note = uridine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
tgcaaataatggtaacctatt

SEQ ID NO: 358 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
taggttaccattatttgcatt

SEQ ID NO: 359 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gcaaataatggtaacctactt

SEQ ID NO: 360 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
gtaggttaccattatttgctt

SEQ ID NO: 361 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ataatggtaacctactgtttt

SEQ ID NO: 362 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
aacagtaggttaccattattt

SEQ ID NO: 363 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ggtaacctactgttaaggatt

SEQ ID NO: 364 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tccttaacagtaggttacctt

SEQ ID NO: 365 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
aagtactagaaggacatgctt

SEQ ID NO: 366 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
gcatgtccttctagtactttt

SEQ ID NO: 367 - RNA, 21 nt, synthetic construct
  source 1..21: mol_type = other RNA
  modified_base 1: mod_base = OTHER; note = adenosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
aaggaagaggacagtttcatt

SEQ ID NO: 368 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tgaaactgtcctcttcctttt

SEQ ID NO: 369 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
ggaggacaagatttgatgatt

SEQ ID NO: 370 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tcatcaaatcttgtcctcctt

SEQ ID NO: 371 - RNA, 21 nt, synthetic construct
  source 1..21: mol_type = other RNA
  modified_base 1: mod_base = OTHER; note = cytidine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
cagagaagaacccgcatcatt

SEQ ID NO: 372 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tgatgcgggttcttctctgtt

SEQ ID NO: 373 - RNA, 21 nt, synthetic construct
  source 1..21: mol_type = other RNA
  modified_base 1: mod_base = OTHER; note = guanosine-3'-phosphate 5'-phosphate 5'-5' inverted abasic nucleoside ester
  modified_base 20: mod_base = OTHER; note = 2'-O-methyluridine-3'-phosphorothioate
  modified_base 21: mod_base = OTHER; note = 2'-O-methyluridine-3'-phosphate 3'-3' linked inverted abasic nucleoside ester
gagaagaacccgcatcaaatt

SEQ ID NO: 374 - RNA, 21 nt, synthetic construct
  source 1..21: mol_type = other RNA
  modified_base 20: mod_base = OTHER; note = 2'-O-methyluridine-3'-phosphorothioate
  modified_base 21: mod_base = OTHER; note = 2'-O-methyluridine
tttgatgcgggttcttctctt

SEQ ID NO: 375 - DNA, 21 bp, synthetic construct
  source 1..21: mol_type = other DNA
  modified_base 1: mod_base = OTHER; note = 2'-O-methyluridine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroadenosine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
tgaaggctgggtacctttgtt

SEQ ID NO: 376 - RNA, 21 nt, synthetic construct
  source 1..21: mol_type = other RNA
  modified_base 1: mod_base = OTHER; note = cytidine-3'-phosphorothioate
  modified_base 2: mod_base = OTHER; note = adenosine-3'-phosphorothioate
  modified_base 3: mod_base = OTHER; note = adenosine-3'-phosphorothioate
  modified_base 4: mod_base = OTHER; note = 2'-deoxy-2'-fluoroadenosine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphorothioate
  modified_base 21: mod_base = OTHER; note = 2'-O-methyluridine
caaaggtacccagccttcatt

SEQ ID NO: 377 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroadenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
atctgtcatcaaattgagttt

SEQ ID NO: 378 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = cytidine-3'-phosphorothioate
  modified_base 3: mod_base = OTHER; note = uridine-3'-phosphorothioate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
actcaatttgatgacagattt

SEQ ID NO: 379 - DNA, 21 bp, synthetic construct
  source 1..21: mol_type = other DNA
  modified_base 1: mod_base = OTHER; note = 2'-O-methyluridine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
tctgtcatcaaattgagtatt

SEQ ID NO: 380 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = adenosine-3'-phosphorothioate
  modified_base 3: mod_base = OTHER; note = cytidine-3'-phosphorothioate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphorothioate
  modified_base 21: mod_base = OTHER; note = 2'-O-methyluridine
tactcaatttgatgacagatt

SEQ ID NO: 381 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ctgtcatcaaattgagtattt

SEQ ID NO: 382 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = uridine-3'-phosphorothioate
  modified_base 3: mod_base = OTHER; note = adenosine-3'-phosphorothioate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
atactcaatttgatgacagtt

SEQ ID NO: 383 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gtcatcaaattgagtattatt

SEQ ID NO: 384 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = adenosine-3'-phosphorothioate
  modified_base 3: mod_base = OTHER; note = adenosine-3'-phosphorothioate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
taatactcaatttgatgactt

SEQ ID NO: 385 - DNA, 21 bp, synthetic construct
  source 1..21: mol_type = other DNA
  modified_base 1: mod_base = OTHER; note = 2'-O-methyluridine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
tcatcaaattgagtattattt

SEQ ID NO: 386 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = uridine-3'-phosphorothioate
  modified_base 3: mod_base = OTHER; note = adenosine-3'-phosphorothioate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphorothioate
  modified_base 21: mod_base = OTHER; note = 2'-O-methyluridine
ataatactcaatttgatgatt

SEQ ID NO: 387 - DNA, 21 bp, synthetic construct
  source 1..21: mol_type = other DNA
  modified_base 1: mod_base = OTHER; note = 2'-O-methyluridine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroadenosine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
tggagacttcaatttgccatt

SEQ ID NO: 388 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = guanosine-3'-phosphorothioate
  modified_base 3: mod_base = OTHER; note = guanosine-3'-phosphorothioate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphorothioate
  modified_base 21: mod_base = OTHER; note = 2'-O-methyluridine
tggcaaattgaagtctccatt

SEQ ID NO: 389 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
acaacagactttaatgtaatt

SEQ ID NO: 390 - DNA, 21 bp, synthetic construct
  source 1..21: mol_type = other DNA
  modified_base 1: mod_base = OTHER; note = 2'-O-methyluridine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
tggatgaaggctgggtacctt

SEQ ID NO: 391 - RNA, 21 nt, synthetic construct
  source 1..21: mol_type = other RNA
  modified_base 1: mod_base = OTHER; note = guanosine-3'-phosphorothioate
  modified_base 2: mod_base = OTHER; note = guanosine-3'-phosphorothioate
  modified_base 3: mod_base = OTHER; note = uridine-3'-phosphorothioate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphorothioate
  modified_base 21: mod_base = OTHER; note = 2'-O-methyluridine
ggtacccagccttcatccatt

SEQ ID NO: 392 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ggatgaaggctgggtaccttt

SEQ ID NO: 393 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = guanosine-3'-phosphorothioate
  modified_base 3: mod_base = OTHER; note = guanosine-3'-phosphorothioate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
aggtacccagccttcatcctt

SEQ ID NO: 394 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroguanosine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gatgaaggctgggtacctttt

SEQ ID NO: 395 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = adenosine-3'-phosphorothioate
  modified_base 3: mod_base = OTHER; note = guanosine-3'-phosphorothioate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
aaggtacccagccttcatctt

SEQ ID NO: 396 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
atgaaggctgggtaccttttt

SEQ ID NO: 397 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = adenosine-3'-phosphorothioate
  modified_base 3: mod_base = OTHER; note = adenosine-3'-phosphorothioate
  modified_base 4: mod_base = OTHER; note = 2'-deoxy-2'-fluoroguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroguanosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
aaaggtacccagccttcattt

SEQ ID NO: 398 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
aaggctgggtacctttggatt

SEQ ID NO: 399 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = cytidine-3'-phosphorothioate
  modified_base 3: mod_base = OTHER; note = cytidine-3'-phosphorothioate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
tccaaaggtacccagcctttt

SEQ ID NO: 400 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroguanosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ggctgggtacctttggaaatt

SEQ ID NO: 401 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = uridine-3'-phosphorothioate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-deoxy-2'-fluoroadenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
tttccaaaggtacccagcctt

SEQ ID NO: 402 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluoroguanosine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ctgggtacctttggaaacatt

SEQ ID NO: 403 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = guanosine-3'-phosphorothioate
  modified_base 3: mod_base = OTHER; note = uridine-3'-phosphorothioate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
tgtttccaaaggtacccagtt

SEQ ID NO: 404 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gcagaccactccctgaagttt

SEQ ID NO: 405 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = cytidine-3'-phosphorothioate
  modified_base 3: mod_base = OTHER; note = uridine-3'-phosphorothioate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
acttcagggagtggtctgctt

SEQ ID NO: 406 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroguanosine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
cctgaagtgacggatgagttt

SEQ ID NO: 407 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = cytidine-3'-phosphorothioate
  modified_base 3: mod_base = OTHER; note = uridine-3'-phosphorothioate
  modified_base 4: mod_base = OTHER; note = 2'-O-methylcytidine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-deoxy-2'-fluoroadenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
actcatccgtcacttcaggtt

SEQ ID NO: 408 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
aaatcatggtgaaataaaatt

SEQ ID NO: 409 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = uridine-3'-phosphorothioate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
ttttatttcaccatgattttt

SEQ ID NO: 410 - DNA, 21 bp, synthetic construct
  source 1..21: mol_type = other DNA
  modified_base 1: mod_base = OTHER; note = 2'-O-methyluridine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-O-methylcytidine-3'-phosphate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-deoxy-2'-fluoroguanosine-3'-phosphate
  modified_base 12: mod_base = OTHER; note = 2'-deoxy-2'-fluoroguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
tgcaaataatggtaacctatt

SEQ ID NO: 411 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = adenosine-3'-phosphorothioate
  modified_base 3: mod_base = OTHER; note = guanosine-3'-phosphorothioate
  modified_base 4: mod_base = OTHER; note = 2'-deoxy-2'-fluoroguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyluridine-3'-phosphorothioate
  modified_base 21: mod_base = OTHER; note = 2'-O-methyluridine
taggttaccattatttgcatt

SEQ ID NO: 412 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-O-methylcytidine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methylcytidine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gcaaataatggtaacctactt

SEQ ID NO: 413 - RNA, 21 nt, synthetic construct
  source 1..21: mol_type = other RNA
  modified_base 1: mod_base = OTHER; note = guanosine-3'-phosphorothioate
  modified_base 2: mod_base = OTHER; note = uridine-3'-phosphorothioate
  modified_base 3: mod_base = OTHER; note = adenosine-3'-phosphorothioate
  modified_base 4: mod_base = OTHER; note = 2'-deoxy-2'-fluoroguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
gtaggttaccattatttgctt

SEQ ID NO: 414 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-O-methyluridine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ataatggtaacctactgtttt

SEQ ID NO: 415 - RNA, 21 nt, synthetic construct
  source 1..21: mol_type = other RNA
  modified_base 1: mod_base = OTHER; note = adenosine-3'-phosphorothioate
  modified_base 2: mod_base = OTHER; note = adenosine-3'-phosphorothioate
  modified_base 3: mod_base = OTHER; note = cytidine-3'-phosphorothioate
  modified_base 4: mod_base = OTHER; note = 2'-deoxy-2'-fluoroadenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-deoxy-2'-fluoroadenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-deoxy-2'-fluoroadenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
aacagtaggttaccattattt

SEQ ID NO: 416 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-O-methyluridine-3'-phosphate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-deoxy-2'-fluoroguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-deoxy-2'-fluoroadenosine-3'-phosphate
  modified_base 16: mod_base = OTHER; note = 2'-deoxy-2'-fluoroadenosine-3'-phosphate
  modified_base 17: mod_base = OTHER; note = 2'-deoxy-2'-fluoroguanosine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ggtaacctactgttaaggatt

SEQ ID NO: 417 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = cytidine-3'-phosphorothioate
  modified_base 3: mod_base = OTHER; note = cytidine-3'-phosphorothioate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-deoxy-2'-fluoroadenosine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
tccttaacagtaggttacctt

SEQ ID NO: 418 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroguanosine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-O-methylcytidine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
aagtactagaaggacatgctt

SEQ ID NO: 419 - RNA, 21 nt, synthetic construct
  source 1..21: mol_type = other RNA
  modified_base 1: mod_base = OTHER; note = guanosine-3'-phosphorothioate
  modified_base 2: mod_base = OTHER; note = cytidine-3'-phosphorothioate
  modified_base 3: mod_base = OTHER; note = adenosine-3'-phosphorothioate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
gcatgtccttctagtactttt

SEQ ID NO: 420 - DNA, 21 bp, synthetic construct
  source 1..21: mol_type = other DNA
  modified_base 1: mod_base = OTHER; note = 2'-deoxy-2'-fluoroadenosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroguanosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
aaggaagaggacagtttcatt

SEQ ID NO: 421 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = guanosine-3'-phosphorothioate
  modified_base 3: mod_base = OTHER; note = adenosine-3'-phosphorothioate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphorothioate
  modified_base 21: mod_base = OTHER; note = 2'-O-methyluridine
tgaaactgtcctcttcctttt

SEQ ID NO: 422 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroguanosine-3'-phosphate
  modified_base 3: mod_base = OTHER; note = 2'-deoxy-2'-fluoroadenosine-3'-phosphate
  modified_base 4: mod_base = OTHER; note = 2'-deoxy-2'-fluoroguanosine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-deoxy-2'-fluoroguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroguanosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
ggaggacaagatttgatgatt

SEQ ID NO: 423 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = cytidine-3'-phosphorothioate
  modified_base 3: mod_base = OTHER; note = adenosine-3'-phosphorothioate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
tcatcaaatcttgtcctcctt

SEQ ID NO: 424 - DNA, 21 bp, synthetic construct
  source 1..21: mol_type = other DNA
  modified_base 1: mod_base = OTHER; note = 2'-O-methylcytidine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroadenosine-3'-phosphate
  modified_base 5: mod_base = OTHER; note = 2'-deoxy-2'-fluoroguanosine-3'-phosphate
  modified_base 6: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
cagagaagaacccgcatcatt

SEQ ID NO: 425 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = guanosine-3'-phosphorothioate
  modified_base 3: mod_base = OTHER; note = adenosine-3'-phosphorothioate
  modified_base 4: mod_base = OTHER; note = 2'-O-methyluridine-3'-phosphate
  modified_base 5: mod_base = OTHER; note = 2'-deoxy-2'-fluoroguanosine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-deoxy-2'-fluoroguanosine-3'-phosphate
  modified_base 20: mod_base = OTHER; note = 2'-O-methyluridine-3'-phosphorothioate
  modified_base 21: mod_base = OTHER; note = 2'-O-methyluridine
tgatgcgggttcttctctgtt

SEQ ID NO: 426 - DNA, 21 bp, synthetic construct
  source 1..21: mol_type = other DNA
  modified_base 1: mod_base = OTHER; note = 2'-deoxy-2'-fluoroguanosine-3'-phosphate 5'-phosphate 5'-5' inverted abasic nucleoside ester
  modified_base 2: mod_base = OTHER; note = 2'-deoxy-2'-fluoroadenosine-3'-phosphate
  modified_base 3: mod_base = OTHER; note = 2'-deoxy-2'-fluoroguanosine-3'-phosphate
  modified_base 4: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 6: mod_base = OTHER; note = 2'-deoxy-2'-fluoroguanosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-deoxy-2'-fluoroguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate 3'-3' linked inverted abasic nucleoside ester
  misc_feature 1..19: note = RNA
  misc_feature 20..21: note = DNA
gagaagaacccgcatcaaatt

SEQ ID NO: 427 - RNA, 21 nt, synthetic construct
  source 1..21: mol_type = other RNA
  modified_base 1: mod_base = OTHER; note = uridine-3'-phosphorothioate
  modified_base 2: mod_base = OTHER; note = uridine-3'-phosphorothioate
  modified_base 3: mod_base = OTHER; note = uridine-3'-phosphorothioate
  modified_base 4: mod_base = OTHER; note = 2'-deoxy-2'-fluoroguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphorothioate
  modified_base 21: mod_base = OTHER; note = 2'-O-methyluridine
tttgatgcgggttcttctctt

SEQ ID NO: 428-429 - skipped (2 entries)

SEQ ID NO: 430 - RNA, 21 nt, synthetic construct
  source 1..21: mol_type = other RNA
  modified_base 2: mod_base = OTHER; note = 2'-O-methyladenosine-3'-phosphate
  modified_base 6: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
tagcgactaaacacatcaatt

SEQ ID NO: 431 - RNA, 21 nt, synthetic construct
  source 1..21: mol_type = other RNA
  modified_base 4: mod_base = OTHER; note = 2'-O-methyladenosine-3'-phosphate
  modified_base 12: mod_base = OTHER; note = 2'-O-methyladenosine-3'-phosphate
  modified_base 19: mod_base = OTHER; note = 2'-O-methyladenosine-3'-phosphate
ttgatgtgtttagtcgctatt

SEQ ID NO: 432 - RNA, 21 nt, synthetic construct
  source 1..21: mol_type = other RNA
  modified_base 3: mod_base = OTHER; note = 2'-O-methylguanosine-3'-phosphate
  modified_base 5: mod_base = OTHER; note = 2'-O-methylguanosine-3'-phosphate
tagcgactaaacacatcaatt

SEQ ID NO: 433 - RNA, 21 nt, synthetic construct
  source 1..21: mol_type = other RNA
  modified_base 3: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 13: mod_base = OTHER; note = 2'-O-methylguanosine-3'-phosphate
  modified_base 16: mod_base = OTHER; note = 2'-O-methylguanosine-3'-phosphate
ttgatgtgtttagtcgctatt

SEQ ID NO: 434 - RNA, 21 nt, synthetic construct
  source 1..21: mol_type = other RNA
  modified_base 4: mod_base = OTHER; note = 2'-O-methylcytidine-3'-phosphate
  modified_base 7: mod_base = OTHER; note = 2'-O-methylcytidine-3'-phosphate
  modified_base 12: mod_base = OTHER; note = 2'-O-methylcytidine-3'-phosphate
  modified_base 14: mod_base = OTHER; note = 2'-O-methylcytidine-3'-phosphate
  modified_base 17: mod_base = OTHER; note = 2'-O-methylcytidine-3'-phosphate
tagcgactaaacacatcaatt

SEQ ID NO: 435 - RNA, 21 nt, synthetic construct
  source 1..21: mol_type = other RNA
  modified_base 15: mod_base = OTHER; note = 2'-O-methylcytidine-3'-phosphate
  modified_base 17: mod_base = OTHER; note = 2'-O-methylcytidine-3'-phosphate
ttgatgtgtttagtcgctatt

SEQ ID NO: 436 - RNA, 21 nt, synthetic construct
  source 1..21: mol_type = other RNA
  modified_base 1: mod_base = OTHER; note = 2'-O-methyluridine-3'-phosphate
  modified_base 2: mod_base = OTHER; note = 2'-O-methyluridine-3'-phosphate
  modified_base 5: mod_base = OTHER; note = 2'-O-methyluridine-3'-phosphate
  modified_base 7: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 14: mod_base = OTHER; note = 2'-O-methyluridine-3'-phosphate
  modified_base 18: mod_base = OTHER; note = 2'-O-methyluridine-3'-phosphate
ttgatgtgtttagtcgctatt

SEQ ID NO: 437 - RNA, 21 nt, synthetic construct
  source 1..21: mol_type = other RNA
  modified_base 1: mod_base = OTHER; note = 2'-O-methyluridine-3'-phosphate
  modified_base 8: mod_base = OTHER; note = 2'-O-methyluridine-3'-phosphate
  modified_base 16: mod_base = OTHER; note = 2'-O-methyluridine-3'-phosphate
tagcgactaaacacatcaatt

SEQ ID NO: 438 - RNA, 21 nt, synthetic construct
  source 1..21: mol_type = other RNA
  modified_base 2: mod_base = OTHER; note = 2'-deoxy-2'-fluoroadenosine-3'-phosphate
  modified_base 6: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 13: mod_base = OTHER; note = 2'-deoxy-2'-fluoroadenosine-3'-phosphate
  modified_base 15: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
tagcgactaaacacatcaatt

SEQ ID NO: 439 - RNA, 21 nt, synthetic construct
  source 1..21: mol_type = other RNA
  modified_base 4: mod_base = OTHER; note = 2'-deoxy-2'-fluoroadenosine-3'-phosphate
  modified_base 12: mod_base = OTHER; note = 2'-deoxy-2'-fluoroadenosine-3'-phosphate
  modified_base 19: mod_base = OTHER; note = 2'-deoxy-2'-fluoroadenosine-3'-phosphate
ttgatgtgtttagtcgctatt

SEQ ID NO: 440 - RNA, 21 nt, synthetic construct
  source 1..21: mol_type = other RNA
  modified_base 3: mod_base = OTHER; note = 2'-deoxy-2'-fluoroguanosine-3'-phosphate
  modified_base 5: mod_base = OTHER; note = 2'-deoxy-2'-fluoroguanosine-3'-phosphate
tagcgactaaacacatcaatt

SEQ ID NO: 441 - RNA, 21 nt, synthetic construct
  source 1..21: mol_type = other RNA
  modified_base 3: mod_base = OTHER; note = 2'-deoxy-2'-fluoroguanosine-3'-phosphate
  modified_base 6: mod_base = OTHER; note = 2'-deoxy-2'-fluoroguanosine-3'-phosphate
  modified_base 8: mod_base = OTHER; note = 2'-deoxy-2'-fluoroguanosine-3'-phosphate
  modified_base 13: mod_base = OTHER; note = 2'-deoxy-2'-fluoroguanosine-3'-phosphate
  modified_base 16: mod_base = OTHER; note = 2'-deoxy-2'-fluoroguanosine-3'-phosphate
ttgatgtgtttagtcgctatt

SEQ ID NO: 442 - RNA, 21 nt, synthetic construct
  source 1..21: mol_type = other RNA
  modified_base 4: mod_base = OTHER; note = 2'-deoxy-2'-fluorocytidine-3'-phosphate
  modified_base 7: mod_base = OTHER; note = 2'-deoxy-2'-fluorocytidine-3'-phosphate
  modified_base 12: mod_base = OTHER; note = 2'-deoxy-2'-fluorocytidine-3'-phosphate
  modified_base 14: mod_base = OTHER; note = 2'-deoxy-2'-fluorocytidine-3'-phosphate
  modified_base 17: mod_base = OTHER; note = 2'-deoxy-2'-fluorocytidine-3'-phosphate
tagcgactaaacacatcaatt

SEQ ID NO: 443 - RNA, 21 nt, synthetic construct
  source 1..21: mol_type = other RNA
  modified_base 15: mod_base = OTHER; note = 2'-deoxy-2'-fluorocytidine-3'-phosphate
  modified_base 17: mod_base = OTHER; note = 2'-deoxy-2'-fluorocytidine-3'-phosphate
ttgatgtgtttagtcgctatt

SEQ ID NO: 444 - RNA, 21 nt, synthetic construct
  source 1..21: mol_type = other RNA
  modified_base 1: mod_base = OTHER; note = 2'-deoxy-2'-fluorouridine-3'-phosphate
  modified_base 2: mod_base = OTHER; note = 2'-deoxy-2'-fluorouridine-3'-phosphate
  modified_base 5: mod_base = OTHER; note = 2'-deoxy-2'-fluorouridine-3'-phosphate
  modified_base 7: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 14: mod_base = OTHER; note = 2'-deoxy-2'-fluorouridine-3'-phosphate
  modified_base 18: mod_base = OTHER; note = 2'-deoxy-2'-fluorouridine-3'-phosphate
ttgatgtgtttagtcgctatt

SEQ ID NO: 445 - RNA, 21 nt, synthetic construct
  source 1..21: mol_type = other RNA
  modified_base 1: mod_base = OTHER; note = 2'-deoxy-2'-fluorouridine-3'-phosphate
  modified_base 8: mod_base = OTHER; note = 2'-deoxy-2'-fluorouridine-3'-phosphate
  modified_base 16: mod_base = OTHER; note = 2'-deoxy-2'-fluorouridine-3'-phosphate
tagcgactaaacacatcaatt

SEQ ID NO: 446 - RNA, 21 nt, synthetic construct
  source 1..21: mol_type = other RNA
aaatcgctgatttgtgtagtt

SEQ ID NO: 447 - RNA, 21 nt, synthetic construct
  source 1..21: mol_type = other RNA
ctacacaaatcagcgattttt

SEQ ID NO: 448 - RNA, 21 nt, synthetic construct
  source 1..21: mol_type = other RNA
  modified_base 1: mod_base = OTHER; note = 2'-O-methyladenosine-3'-phosphate
  modified_base 2: mod_base = OTHER; note = 2'-O-methyladenosine-3'-phosphate
  modified_base 3: mod_base = OTHER; note = 2'-O-methyladenosine-3'-phosphate
  modified_base 10: mod_base = OTHER; note = 2'-O-methyladenosine-3'-phosphate
  modified_base 18: mod_base = OTHER; note = 2'-O-methyladenosine-3'-phosphate
aaatcgctgatttgtgtagtt

SEQ ID NO: 449 - RNA, 21 nt, synthetic construct
  source 1..21: mol_type = other RNA
  modified_base 3: mod_base = OTHER; note = 2'-O-methyladenosine-3'-phosphate
  modified_base 5: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 12: mod_base = OTHER; note = 2'-O-methyladenosine-3'-phosphate
  modified_base 16: mod_base = OTHER; note = 2'-O-methyladenosine-3'-phosphate
ctacacaaatcagcgattttt

SEQ ID NO: 450 - RNA, 21 nt, synthetic construct
  source 1..21: mol_type = other RNA
  modified_base 6: mod_base = OTHER; note = 2'-O-methylguanosine-3'-phosphate
  modified_base 9: mod_base = OTHER; note = 2'-O-methylguanosine-3'-phosphate
  modified_base 14: mod_base = OTHER; note = 2'-O-methylguanosine-3'-phosphate
  modified_base 16: mod_base = OTHER; note = 2'-O-methylguanosine-3'-phosphate
  modified_base 19: mod_base = OTHER; note = 2'-O-methylguanosine-3'-phosphate
aaatcgctgatttgtgtagtt

SEQ ID NO: 451 - RNA, 21 nt, synthetic construct
  source 1..21: mol_type = other RNA
  modified_base 13: mod_base = OTHER; note = 2'-O-methylguanosine-3'-phosphate
  modified_base 15: mod_base = OTHER; note = 2'-O-methylguanosine-3'-phosphate
ctacacaaatcagcgattttt

SEQ ID NO: 452 - RNA, 21 nt, synthetic construct
  source 1..21: mol_type = other RNA
  modified_base 1: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 11: mod_base = OTHER; note = 2'-O-methylcytidine-3'-phosphate
  modified_base 14: mod_base = OTHER; note = 2'-O-methylcytidine-3'-phosphate
ctacacaaatcagcgattttt

SEQ ID NO: 453 - RNA, 21 nt, synthetic construct
  source 1..21: mol_type = other RNA
  modified_base 5: mod_base = OTHER; note = 2'-O-methylcytidine-3'-phosphate
  modified_base 7: mod_base = OTHER; note = 2'-O-methylcytidine-3'-phosphate
aaatcgctgatttgtgtagtt

SEQ ID NO: 454 - RNA, 21 nt, synthetic construct
  source 1..21: mol_type = other RNA
  modified_base 4: mod_base = OTHER; note = 2'-O-methyluridine-3'-phosphate
  modified_base 8: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methyluridine-3'-phosphate
  modified_base 17: mod_base = OTHER; note = 2'-O-methyluridine-3'-phosphate
aaatcgctgatttgtgtagtt

SEQ ID NO: 455 - RNA, 21 nt, synthetic construct
  source 1..21: mol_type = other RNA
  modified_base 2: mod_base = OTHER; note = 2'-O-methyluridine-3'-phosphate
  modified_base 10: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
ctacacaaatcagcgattttt

SEQ ID NO: 456 - RNA, 21 nt, synthetic construct
  source 1..21: mol_type = other RNA
  modified_base 1: mod_base = OTHER; note = 2'-deoxy-2'-fluoroadenosine-3'-phosphate
  modified_base 2: mod_base = OTHER; note = 2'-deoxy-2'-fluoroadenosine-3'-phosphate
  modified_base 3: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 18: mod_base = OTHER; note = 2'-deoxy-2'-fluoroadenosine-3'-phosphate
aaatcgctgatttgtgtagtt

SEQ ID NO: 457 - RNA, 21 nt, synthetic construct
  source 1..21: mol_type = other RNA
  modified_base 3: mod_base = OTHER; note = 2'-deoxy-2'-fluoroadenosine-3'-phosphate
  modified_base 5: mod_base = OTHER; note = 2'-deoxy-2'-fluoroadenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 12: mod_base = OTHER; note = 2'-deoxy-2'-fluoroadenosine-3'-phosphate
  modified_base 16: mod_base = OTHER; note = 2'-deoxy-2'-fluoroadenosine-3'-phosphate
ctacacaaatcagcgattttt

SEQ ID NO: 458 - RNA, 21 nt, synthetic construct
  source 1..21: mol_type = other RNA
  modified_base 6: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 14: mod_base = OTHER; note = 2'-deoxy-2'-fluoroguanosine-3'-phosphate
  modified_base 16: mod_base = OTHER; note = 2'-deoxy-2'-fluoroguanosine-3'-phosphate
  modified_base 19: mod_base = OTHER; note = 2'-deoxy-2'-fluoroguanosine-3'-phosphate
aaatcgctgatttgtgtagtt

SEQ ID NO: 459 - RNA, 21 nt, synthetic construct
  source 1..21: mol_type = other RNA
  modified_base 13: mod_base = OTHER; note = 2'-deoxy-2'-fluoroguanosine-3'-phosphate
  modified_base 15: mod_base = OTHER; note = 2'-deoxy-2'-fluoroguanosine-3'-phosphate
ctacacaaatcagcgattttt

SEQ ID NO: 460 - RNA, 21 nt, synthetic construct
  source 1..21: mol_type = other RNA
  modified_base 1: mod_base = OTHER; note = 2'-deoxy-2'-fluorocytidine-3'-phosphate
  modified_base 4: mod_base = OTHER; note = 2'-deoxy-2'-fluorocytidine-3'-phosphate
  modified_base 6: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 14: mod_base = OTHER; note = 2'-deoxy-2'-fluorocytidine-3'-phosphate
ctacacaaatcagcgattttt

SEQ ID NO: 461 - RNA, 21 nt, synthetic construct
  source 1..21: mol_type = other RNA
  modified_base 5: mod_base = OTHER; note = 2'-deoxy-2'-fluorocytidine-3'-phosphate
  modified_base 7: mod_base = OTHER; note = 2'-deoxy-2'-fluorocytidine-3'-phosphate
aaatcgctgatttgtgtagtt

SEQ ID NO: 462 - RNA, 21 nt, synthetic construct
  source 1..21: mol_type = other RNA
  modified_base 4: mod_base = OTHER; note = 2'-deoxy-2'-fluorouridine-3'-phosphate
  modified_base 8: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-deoxy-2'-fluorouridine-3'-phosphate
  modified_base 13: mod_base = OTHER; note = 2'-deoxy-2'-fluorouridine-3'-phosphate
  modified_base 15: mod_base = OTHER; note = 2'-deoxy-2'-fluorouridine-3'-phosphate
  modified_base 17: mod_base = OTHER; note = 2'-deoxy-2'-fluorouridine-3'-phosphate
aaatcgctgatttgtgtagtt

SEQ ID NO: 463 - RNA, 21 nt, synthetic construct
  source 1..21: mol_type = other RNA
  modified_base 2: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 17: mod_base = OTHER; note = 2'-deoxy-2'-fluorouridine-3'-phosphate
  modified_base 18: mod_base = OTHER; note = 2'-deoxy-2'-fluorouridine-3'-phosphate
  modified_base 19: mod_base = OTHER; note = 2'-deoxy-2'-fluorouridine-3'-phosphate
ctacacaaatcagcgattttt

SEQ ID NO: 464 - RNA, 23 nt, synthetic construct
  source 1..23: mol_type = other RNA
attggtattcagtgtgatgacac

SEQ ID NO: 465 - RNA, 21 nt, synthetic construct
  source 1..21: mol_type = other RNA
gtcatcacactgaataccaat

SEQ ID NO: 466 - RNA, 23 nt, synthetic construct
  source 1..23: mol_type = other RNA
  modified_base 1: mod_base = OTHER; note = 2'-O-methyladenosine-3'-phosphate
  modified_base 7: mod_base = OTHER; note = 2'-O-methyladenosine-3'-phosphate
  modified_base 11: mod_base = OTHER; note = 2'-O-methyladenosine-3'-phosphate
  modified_base 17: mod_base = OTHER; note = 2'-O-methyladenosine-3'-phosphate
  modified_base 20: mod_base = OTHER; note = 2'-O-methyladenosine-3'-phosphate
  modified_base 22: mod_base = OTHER; note = 2'-O-methyladenosine-3'-phosphate
attggtattcagtgtgatgacac

SEQ ID NO: 467 - RNA, 21 nt, synthetic construct
  source 1..21: mol_type = other RNA
  modified_base 4: mod_base = OTHER; note = 2'-O-methyladenosine-3'-phosphate
  modified_base 7: mod_base = OTHER; note = 2'-O-methyladenosine-3'-phosphate
  modified_base 9: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 16: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
gtcatcacactgaataccaat

SEQ ID NO: 468 - RNA, 21 nt, synthetic construct
  source 1..21: mol_type = other RNA
  modified_base 1: mod_base = OTHER; note = 2'-O-methylguanosine-3'-phosphate
  modified_base 12: mod_base = OTHER; note = 2'-O-methylguanosine-3'-phosphate
gtcatcacactgaataccaat

SEQ ID NO: 469 - RNA, 23 nt, synthetic construct
  source 1..23: mol_type = other RNA
  modified_base 4: mod_base = OTHER; note = 2'-O-methylguanosine-3'-phosphate
  modified_base 5: mod_base = OTHER; note = 2'-O-methylguanosine-3'-phosphate
  modified_base 12: mod_base = OTHER; note = 2'-O-methylguanosine-3'-phosphate
  modified_base 14: mod_base = OTHER; note = 2'-O-methylguanosine-3'-phosphate
  modified_base 16: mod_base = OTHER; note = 2'-O-methylguanosine-3'-phosphate
  modified_base 19: mod_base = OTHER; note = 2'-O-methylguanosine-3'-phosphate
attggtattcagtgtgatgacac

SEQ ID NO: 470 - RNA, 23 nt, synthetic construct
  source 1..23: mol_type = other RNA
  modified_base 10: mod_base = OTHER; note = 2'-O-methylcytidine-3'-phosphate
  modified_base 21: mod_base = OTHER; note = 2'-O-methylcytidine-3'-phosphate
  modified_base 23: mod_base = OTHER; note = 2'-O-methylcytidine
attggtattcagtgtgatgacac

SEQ ID NO: 471 - RNA, 21 nt, synthetic construct
  source 1..21: mol_type = other RNA
  modified_base 3: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
gtcatcacactgaataccaat

SEQ ID NO: 472 - RNA, 23 nt, synthetic construct
  source 1..23: mol_type = other RNA
  modified_base 2: mod_base = OTHER; note = 2'-O-methyluridine-3'-phosphate
  modified_base 3: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methyluridine-3'-phosphate
  modified_base 18: mod_base = OTHER; note = 2'-O-methyluridine-3'-phosphate
attggtattcagtgtgatgacac

SEQ ID NO: 473 - RNA, 21 nt, synthetic construct
  source 1..21: mol_type = other RNA
  modified_base 2: mod_base = OTHER; note = 2'-O-methyluridine-3'-phosphate
  modified_base 5: mod_base = OTHER; note = 2'-O-methyluridine-3'-phosphate
  modified_base 11: mod_base = OTHER; note = 2'-O-methyluridine-3'-phosphate
  modified_base 15: mod_base = OTHER; note = 2'-O-methyluridine-3'-phosphate
  modified_base 21: mod_base = OTHER; note = 2'-O-methyluridine
gtcatcacactgaataccaat

SEQ ID NO: 474 - RNA, 21 nt, synthetic construct
  source 1..21: mol_type = other RNA
  modified_base 1: mod_base = OTHER; note = 2'-deoxy-2'-fluorocytidine-3'-phosphate
  modified_base 2: mod_base = OTHER; note = 2'-deoxy-2'-fluorocytidine-3'-phosphate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-deoxy-2'-fluorouridine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine
cctgaagagagttaaaagatt

SEQ ID NO: 475 - DNA, 21 bp, synthetic construct
  source 1..21: mol_type = other DNA
  modified_base 1: mod_base = OTHER; note = 2'-deoxy-2'-fluorouridine-3'-phosphate 5'-phosphate 5'-5' inverted abasic nucleoside ester
  modified_base 2: mod_base = OTHER; note = 2'-deoxy-2'-fluorocytidine-3'-phosphate
  modified_base 3: mod_base = OTHER; note = 2'-deoxy-2'-fluorouridine-3'-phosphate
  modified_base 4: mod_base = OTHER; note = 2'-deoxy-2'-fluorouridine-3'-phosphate
  modified_base 5: mod_base = OTHER; note = 2'-deoxy-2'-fluorouridine-3'-phosphate
  modified_base 6: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-deoxy-2'-fluorouridine-3'-phosphate
  modified_base 13: mod_base = OTHER; note = 2'-deoxy-2'-fluorocytidine-3'-phosphate
  modified_base 14: mod_base = OTHER; note = 2'-deoxy-2'-fluorouridine-3'-phosphate
  modified_base 15: mod_base = OTHER; note = 2'-deoxy-2'-fluorouridine-3'-phosphate
  modified_base 16: mod_base = OTHER; note = 2'-deoxy-2'-fluorocytidine-3'-phosphate
  modified_base 21: mod_base = OTHER; note = 2'-deoxythymidine-3'-phosphate 3'-3' linked inverted abasic nucleoside ester
  misc_feature 1..6: note = RNA
  misc_feature 9..16: note = RNA
  misc_feature 7..8: note = DNA
  misc_feature 17..21: note = DNA
tcttttaactctcttcaggtt

What we claim is:

1. A compound comprising:
   I) a double-stranded short interfering nucleic acid (siNA) molecule that inhibits the expression of a target gene via RNA interference, comprising a sense strand and an antisense strand, said siNA molecule comprising formula (A):

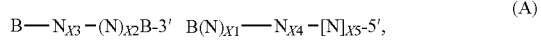

B—$N_{X3}$-$(N)_{X2}$B-3'  B(N)$_{X1}$—$N_{X4}$-[N]$_{X5}$-5',  (A)

wherein, the upper strand is the sense strand and the lower strand is the antisense strand of the siNA molecule; wherein the antisense strand comprises a sequence having at least 15 nucleotides that are complementary to a target RNA sequence encoded by the target gene and the sense strand comprises a sequence that is complementary to the antisense strand; each N is independently a nucleotide which is unmodified or chemically modified, or is a non-nucleotide; each B is independently a terminal cap; (N) represents overhanging nucleotides, each of which is independently unmodified or chemically modified; [N] represents nucleotides at the 5'-terminus of the antisense strand; X1 and X2 are independently integers from 0 to 4; X3 is an integer from 15 to 30; X4 is an integer from 12 to 27; and X5 is an integer from 1-6, provided that the sum of X4 and X5 is an integer from 15-30; and wherein
   (a) five or more pyrimidine nucleotides in $N_{X4}$ positions are a combination of two or more of independently 2'-deoxy-2'-fluoro nucleotides, 2'-O-alkyl nucleotides, 2'deoxy nucleotides, ribonucleotides, or any combination thereof;
   (b) five or more purine nucleotides in $N_{X4}$ positions are independently 2'-deoxy-2'-fluoro nucleotides, 2'-O-alkyl nucleotides, 2'deoxy nucleotides, ribonucleotides, or any combination thereof;
   (c) five or more pyrimidine nucleotides in $N_{X3}$ positions are independently 2'-deoxy-2'-fluoro nucleotides, 2'-O-alkyl nucleotides, 2'deoxy nucleotides, ribonucleotides, or any combination thereof;
   (d) five or more purine nucleotides in $N_{X3}$ positions are independently 2'-deoxy-2'-fluoro nucleotides, 2'-O-alkyl nucleotides, 2'deoxy nucleotides, ribonucleotides;
   (e) [N] position nucleotide(s) are ribonucleotides, deoxyribonucleotides, 2'-O-alkyl nucleotides, or 2'-halo nucleotides, or any combination thereof irrespective of purine or pyrimidine content; and
   (f) the nucleotide at position 14 from the 5'-end of the antisense strand is a 2'-deoxy-2'-fluoro nucleotide regardless of whether it is a purine or pyrimidine; and
   II) a ligand covalently attached to the siNA molecule.

2. The compound according to claim 1, wherein each B is an inverted abasic moiety.

3. The compound according to claim 2, wherein:
   (a) five or more pyrimidine nucleotides in $N_{X4}$ positions are 2'-O-methyl nucleotides;
   (b) five or more purine nucleotides in $N_{X4}$ positions are 2'-deoxy-2'-fluoro nucleotides;
   (c) five or more pyrimidine nucleotides in $N_{X3}$ positions are 2'-O-methyl nucleotides;
   (d) five or more purine nucleotides in $N_{X3}$ positions are 2'-deoxy-2'-fluoro nucleotides; and
   (e) [N] position nucleotide(s) are any combination of ribonucleotides, deoxyribonucleotides, 2'-O-alkyl nucleotides, or 2'-halo nucleotides.

4. The compound according to claim 2, wherein:
   (a) 5, 6, 7, 8, 9, 10 or more pyrimidine nucleotides in $N_{X4}$ positions are 2'-O-methyl nucleotides;
   (b) 5, 6, 7, 8, 9, 10 or more purine nucleotides in $N_{X4}$ positions are 2'-deoxy-2'-fluoro nucleotides;
   (c) 5, 6, 7, 8, 9, 10 or more pyrimidine nucleotides in $N_{X3}$ positions are 2'-O-methyl nucleotides;
   (d) 5, 6, 7, 8, 9, 10 or more purine nucleotides in $N_{X3}$ positions are 2'-deoxy-2'-fluoro nucleotides; and
   (e) [N] position nucleotide(s) are any combination of ribonucleotides, deoxyribonucleotides, 2'-O-alkyl nucleotides, or 2'-halo nucleotides.

5. The compound according to claim 2, wherein X5 is 3.

6. The compound according to claim 5, wherein the three [N] nucleotides of formula (A) are represented as 5'-[N1, N2, N3]-3', wherein:
  a. each N1, N2, and N3 is a ribonucleotide; or
  b. each N1, N2, and N3 is a 2'-deoxy-2'-fluoro nucleotide; or
  c. each N1, N2, and N3 is a 2'-deoxy nucleotide; or
  d. each N1, N2, and N3 is a 2'-O-alkyl nucleotide; and
  e. any of N1, N2, or N3 optionally comprises a phosphorothioate internucleotide linkage.

7. The compound according to claim 5, wherein the three [N] nucleotides of formula (A) are represented as 5'-[N1, N2, N3]-3', wherein:
  a. N1 is a 2'-deoxy-2'-fluoro nucleotide, N2 is 2'-deoxy-2'-fluoro nucleotide, and N3 is a 2'-deoxynucleotide; and
  b. any of N1, N2, or N3 optionally comprises a phosphorothioate internucleotide linkage.

8. The compound according to claim 5, wherein the three [N] nucleotides of formula (A) are represented as 5'-[N1, N2, N3]-3', wherein:
  a. N1 is a 2'-deoxy nucleotide, N2 is 2'-deoxy-2'-fluoro nucleotide, and N3 is a 2'-O-methyl nucleotide; and
  b. any of N1, N2, or N3 optionally comprises a phosphorothioate internucleotide linkage.

9. The compound according to claim 5, wherein the three [N] nucleotides of formula (A) are represented as 5'-[N1, N2, N3]-3', wherein:
  a. N1 is a 2'-deoxy nucleotide, N2 is 2'-deoxy-2'-fluoro nucleotide, and N3 is a 2'-deoxy nucleotide; and
  b. any of N1, N2, or N3 optionally comprises a phosphorothioate internucleotide linkage.

10. The compound according to claim 5, wherein the three [N] nucleotides of formula (A) are represented as 5'-[N1, N2, N3]-3', wherein:
  a. N1 is a 2'-deoxy-2'-fluoro nucleotide, N2 is 2'-deoxy-2'-fluoro nucleotide, and N3 is a 2'-deoxy-2'-fluoro nucleotide; and
  b. any of N1, N2, or N3 optionally comprises a phosphorothioate internucleotide linkage.

11. The compound according to claim 2, wherein X1 is 2.

12. The compound according to claim 2, wherein X5 is 3, X1 is 2 and X2 is 2.

13. The compound according to claim 2, wherein said siNA molecule comprises one or more universal base substitutions.

14. The compound according to claim 2, wherein said double-stranded short interfering nucleic acid (siNA) molecule includes one or more locked nucleic acid (LNA) substitutions.

15. The compound according to claim 2, wherein one or more overhanging nucleotides of said siNA molecule is a 2'-O-methyl nucleotide.

16. The compound according to claim 2, wherein said double-stranded short interfering nucleic acid (siNA) molecule comprises at least one phosphorothioate internucleotide linkage.

17. The compound according to claim 2, wherein X5=3; each X1 and X2=1 or 2; X3=18, 19, 20, 21, 22, or 24, and X4=17, 18, 19, 20, 21, 22, or 23.

18. The compound according to claim 2, wherein X5=3; each X1 and X2=2; X3=19, and X4=16.

19. The compound of claim 2, wherein the 2'-O-alkyl nucleotide is a 2'-O-methyl nucleotide.

20. The compound of claim 2, wherein the 2'-halo nucleotide is a 2'-deoxy-2'-fluoro nucleotide.

21. The compound of claim 2, wherein five or more purine nucleotides in the $N_{X4}$ positions are 2'-O-methyl nucleotides.

22. The compound of claim 2, wherein five or more pyrimidines in the $N_{X4}$ positions are 2'-fluoro nucleotides.

23. The compound of claim 2, wherein five or more purine nucleotides in the $N_{X3}$ positions are 2'-O-methyl nucleotides.

24. The compound of claim 2, wherein five or more purine nucleotides in the $N_{X3}$ positions are 2'-fluoro nucleotides.

25. The compound of claim 2, wherein five or more pyrimidine nucleotides in the $N_{X3}$ positions are 2'-fluoro nucleotides.

26. The compound of claim 2, wherein:
  (a) 5, 6, 7, 8, 9, 10 or more of the pyrimidine and purine nucleotides in the $N_{X4}$ positions are independently chosen from 2'-O-methyl nucleotides or 2'-deoxy-2'-fluoro nucleotides, or any combination thereof;
  (b) 5, 6, 7, 8, 9, 10 or more of the pyrimidine and purine nucleotides in the $N^{X3}$ positions are independently chosen from 2'-O-methyl nucleotides or 2'-deoxy-2'-fluoro nucleotides, or any combination thereof; and
  (c) [N] position nucleotide(s) are any combination of ribonucleotides, deoxyribonucleotides, 2'-O-alkyl nucleotides, 2'-halo nucleotides, or any combination thereof irrespective of the purine or pyrimidine content.

27. The compound of claim 2, wherein at least 5 or more of the pyrimidine nucleotides in one or both strands are 2'-deoxy-2'-fluoro pyrimidine nucleotides and at least 5 or more purine nucleotides in one or both strands are 2'-O-methyl purine nucleotides.

28. The compound of claim 2, wherein at least 5 or more of the pyrimidine nucleotides in one or both strands are 2'-O-methyl pyrimidine nucleotides and at least 5 or more purine nucleotides in one or both strands are 2'-deoxy-2'-fluoro purine nucleotides.

29. The compound of claim 2, wherein said siNA molecule comprises one or more acyclic nucleotides.

30. The compound of claim 2, further comprising one or more phosphorothioate linkages between the first terminal (N) and the adjacent nucleotide on the 3' end of the sense strand.

31. The compound of claim 2, wherein X1=2 overhanging nucleotide positions with a phosphorothioate internucleotide linkage.

32. The compound of claim 2, wherein the ligand is chosen from a steroidal compound, a galactosamine, a vitamin, a protein, a peptide, or an antibody.

33. The compound of claim 32, wherein the ligand is a cholesterol.

34. The compound of claim 32, wherein the ligand comprises one or more N-acetylgalactosamine.

35. The compound of claim 32, wherein the ligand is covalently attached to the siNA molecule via a linker.

36. The compound of claim 2, wherein one B comprises a delivery modality, wherein the delivery modality comprises the ligand and further includes one or more linker molecules.

37. The compound of claim 35, wherein the linker is chosen from a phosphate ester based linker, an amino based linker, a disulfide based linker, a succinyl based linker, an alkyl or substituted alkyl based linker, or an amide based linker.

38. The compound of claim 2, wherein the ligand is attached at the 5'-end of the sense strand.

39. The compound of claim 2, wherein the ligand is attached at the 3'-end of the sense strand.

40. The compound of claim 2, wherein (a) all pyrimidine nucleotides in $N_{X4}$ positions are 2'-O-methyl nucleotides;
(b) all purine nucleotides in $N_{X4}$ positions are 2'-halo nucleotides;
(c) all pyrimidine nucleotides in $N_{X3}$ positions are 2'-O-alkyl nucleotides;
(d) all purine nucleotides in $N_{X3}$ positions are 2'-halo nucleotides; and
(e) [N] position nucleotide(s) are any combination of ribonucleotides, deoxyribonucleotides, 2'-O-alkyl nucleotides, or 2'-halo nucleotides;
(f) the nucleotide at position 14 from the 5'-end of the antisense strand is a 2'-deoxy-2'-fluoro nucleotide regardless of whether it is a purine or pyrimidine; and
(g) [N] nucleotides of formula (A) are represented as 5'-[N1, N2, N3]-3', wherein
  i) N1 is a 2'-deoxy nucleotide, N2 is 2'-deoxy-2'-fluoro nucleotide, and N3 is a 2'-deoxy nucleotide; or
  ii) N1 is a 2'-deoxy-2'-fluoro nucleotide, N2 is 2'-deoxy-2'-fluoro nucleotide, and N3 is a 2'-deoxy-2'-fluoro nucleotide; or
  iii) N1 is a 2'-deoxy-2'-fluoro nucleotide, N2 is 2'-deoxy-2'-fluoro nucleotide, and N3 is a 2'-deoxynucleotide; or
  iv) N1 is a 2'-deoxy nucleotide, N2 is 2'-deoxy-2'-fluoro nucleotide, and N3 is a 2'-O-methyl nucleotide; or
  v) N1, N2, and N3 are all ribonucleotides having phosphorothioate internucleotide linkages.

41. A composition comprising the siNA molecule according to claim 2 and a pharmaceutically acceptable carrier or diluent.

* * * * *